US012729376B2

(12) United States Patent
Artz et al.

(10) Patent No.: US 12,729,376 B2
(45) Date of Patent: Sep. 8, 2026

(54) ENGINEERED DNA LIGASE VARIANTS

(71) Applicant: Codexis, Inc., Redwood City, CA (US)

(72) Inventors: Jacob Hansen Artz, Redwood City, CA (US); Rachelle Copeland, Redwood City, CA (US); Jason Fell, Martinez, CA (US); Anders Matthew Knight, Mountain View, CA (US); Mikayla Jianghongxia Krawczyk, Palo Alto, CA (US); Mathew G. Miller, San Carlos, CA (US); Jovana Nazor, Milpitas, CA (US); Amani Shoubber, Santa Clara, CA (US); Jonathan Vroom, South San Francisco, CA (US)

(73) Assignee: Codexis, Inc., Redwood City, CA (US)

( * ) Notice: Subject to any disclaimer, the term of this patent is extended or adjusted under 35 U.S.C. 154(b) by 319 days.

(21) Appl. No.: 18/420,040

(22) Filed: Jan. 23, 2024

(65) Prior Publication Data

US 2024/0309353 A1 Sep. 19, 2024

Related U.S. Application Data

(60) Provisional application No. 63/481,158, filed on Jan. 23, 2023.

(51) Int. Cl.
*C12N 9/00* (2006.01)
*C12N 15/10* (2006.01)
*C12N 15/63* (2006.01)
*C12P 19/34* (2006.01)

(52) U.S. Cl.
CPC ............... *C12N 9/93* (2013.01); *C12N 15/10* (2013.01); *C12N 15/63* (2013.01); *C12P 19/34* (2013.01); *C12Y 605/01001* (2013.01)

(58) Field of Classification Search
CPC .......... C12N 9/93; C12N 15/10; C12N 15/63; C12P 19/34; C12Y 605/01001; C07K 2319/02
See application file for complete search history.

(56) References Cited

U.S. PATENT DOCUMENTS 4,582,802 A 4/1986 Zimmerman et al.
5,605,793 A 2/1997 Stemmer
5,811,238 A 9/1998 Stemmer et al.
5,830,721 A 11/1998 Stemmer et al.
5,834,252 A 11/1998 Stemmer et al.
5,837,458 A 11/1998 Minshull et al.
5,928,905 A 7/1999 Stemmer et al.
6,096,548 A 8/2000 Stemmer
6,117,679 A 9/2000 Stemmer
6,132,970 A 10/2000 Stemmer
6,165,793 A 12/2000 Stemmer
6,180,406 B1 1/2001 Stemmer
6,251,674 B1 6/2001 Tobin et al.
6,265,201 B1 7/2001 Wackett et al.
6,277,638 B1 8/2001 Stemmer
6,287,861 B1 9/2001 Stemmer et al.
6,287,862 B1 9/2001 DelCardayre et al.
6,291,242 B1 9/2001 Stemmer
6,297,053 B1 10/2001 Stemmer
6,303,344 B1 10/2001 Patten et al.
6,309,883 B1 10/2001 Minshull et al.
6,319,713 B1 11/2001 Patten et al.
6,319,714 B1 11/2001 Crameri et al.
6,323,030 B1 11/2001 Stemmer
6,326,204 B1 12/2001 DelCardayre et al.
6,335,160 B1 1/2002 Patten et al.
6,335,198 B1 1/2002 DelCardayre et al.
6,337,186 B1 1/2002 Krebber
6,344,356 B1 2/2002 Stemmer
6,352,859 B1 3/2002 DelCardayre et al.
6,355,484 B1 3/2002 Patten et al.
6,358,740 B1 3/2002 Patten et al.
6,358,742 B1 3/2002 Stemmer
6,365,377 B1 4/2002 Patten et al.
6,365,408 B1 4/2002 Stemmer
6,368,861 B1 4/2002 Crameri et al.
6,372,497 B1 4/2002 Stemmer
6,376,246 B1 4/2002 Crameri et al.
6,379,964 B1 4/2002 Del Cardayre et al.
6,387,702 B1 5/2002 Stemmer
6,391,552 B2 5/2002 Stemmer (Continued)

FOREIGN PATENT DOCUMENTS

WO 95/22625 8/1995
WO 95/33836 12/1995

(Continued)

OTHER PUBLICATIONS

UniProt Accession No. S5MMW2_9CAUD (1 page, Oct. 16, 2013) (Year: 2013).*
International Searching Authority, International Search Report for International Patent Application No. PCT/US2024/012543 (Jun. 18, 2024).
International Searching Authority, Written Opinion of the International Searching Authority for International Patent Application No. PCT/US2024/012543 (Jun. 18, 2024).
Unitprot, Accession No. S5MAP2 <Url: rest.uniprot.org/unisave/S5MAP2?format=txt&versions=27> (Dec. 14, 2022).
Stephen F. Altschul, et al., "Basic Local Alignment Search Tool," J. Mol. Biol. 215:403-410 (1990).
Stephen F. Altschul, et al., "Gapped BLAST and PSI-BLAST: a new generation of protein database search programs," Nucleic Acids Research 25(17):3389-3402 (1997).

(Continued)

*Primary Examiner* — David Steadman
*Assistant Examiner* — Joseph R Spangler
(74) *Attorney, Agent, or Firm* — Eric Grant Lee

(57) ABSTRACT

The present disclosure relates to engineered DNA ligase polypeptides and compositions thereof, as well as polynucleotides encoding the engineered DNA ligase polypeptides. The present disclosure also provides methods of using the engineered DNA ligase polypeptides or compositions thereof in diagnostics and as a molecular biological tool.

13 Claims, No Drawings

Specification includes a Sequence Listing.

(56) References Cited

U.S. PATENT DOCUMENTS 6,391,640 B1 5/2002 Minshull et al.
6,395,547 B1 5/2002 Stemmer
6,406,855 B1 6/2002 Patten et al.
6,406,910 B1 6/2002 Patten et al.
6,413,745 B1 7/2002 Patten et al.
6,413,774 B1 7/2002 Stemmer et al.
6,420,175 B1 7/2002 Stemmer
6,423,542 B1 7/2002 Crameri et al.
6,426,224 B1 7/2002 Crameri et al.
6,436,675 B1 8/2002 Welch et al.
6,444,468 B1 9/2002 Stemmer
6,455,253 B1 9/2002 Patten et al.
6,686,515 B1 2/2004 Lassner et al.
6,703,240 B1 3/2004 Stemmer et al.
6,716,631 B1 4/2004 DelCardayre et al.
6,825,001 B2 11/2004 Wackett et al.
6,902,922 B2 6/2005 Ness et al.
6,917,882 B2 7/2005 Selifonov et al.
6,946,296 B2 9/2005 Patten et al.
6,961,664 B2 11/2005 Selifonov et al.
6,995,017 B1 2/2006 Stemmer
7,024,312 B1 4/2006 Selifonov et al.
7,058,515 B1 6/2006 Selifonov et al.
7,105,297 B2 9/2006 Minshull et al.
7,148,054 B2 12/2006 DelCardayre et al.
7,220,566 B2 5/2007 Ness et al.
7,288,375 B2 10/2007 Stemmer et al.
7,384,387 B1 6/2008 Raillard et al.
7,421,347 B2 9/2008 Selifonov et al.
7,430,477 B2 9/2008 Selfonov et al.
7,462,469 B2 12/2008 Bass et al.
7,534,564 B2 5/2009 Patten et al.
7,620,500 B2 11/2009 Mundorff et al.
7,620,502 B2 11/2009 Selifonov et al.
7,629,157 B2 12/2009 Davis et al.
7,629,170 B2 12/2009 DelCardayre et al.
7,702,464 B1 4/2010 Emig et al.
7,747,391 B2 6/2010 Gustafsson et al.
7,747,393 B2 6/2010 Fox
7,751,986 B2 7/2010 Gustafsson et al.
7,776,598 B2 8/2010 Patten et al.
7,783,428 B2 8/2010 Gustafsson et al.
7,795,030 B2 9/2010 Minshull et al.
7,853,410 B2 12/2010 Selifonov et al.
7,868,138 B2 1/2011 Stemmer et al.
7,873,477 B1 1/2011 Gustafsson et al.
7,873,499 B2 1/2011 Selifonov et al.
7,904,249 B2 3/2011 Selifonov et al.
7,957,912 B2 6/2011 Selifonov et al.
7,981,614 B2 7/2011 Stemmer et al.
8,014,961 B2 9/2011 Bass et al.
8,029,988 B2 10/2011 Crameri et al.
8,048,674 B2 11/2011 Minshull et al.
8,058,001 B2 11/2011 Crameri et al.
8,076,138 B2 12/2011 DelCardayre et al.
8,108,150 B2 1/2012 Mundorff et al.
8,170,806 B2 5/2012 Selifonov et al.
8,224,580 B2 7/2012 Mundorff et al.
8,377,681 B2 2/2013 DelCardayre et al.
8,383,346 B2 2/2013 Colbeck et al.
8,457,903 B1 6/2013 Emig et al.
8,504,498 B2 8/2013 Fox
8,589,085 B2 11/2013 Selifonov et al.
8,728,725 B2 5/2014 Paul et al.
8,762,066 B2 6/2014 Fox
8,768,871 B2 7/2014 Fox
9,499,811 B2 11/2016 Rebecca et al.
9,593,326 B2 3/2017 Clark et al.
10,837,009 B1 11/2020 Ong et al.
2008/0220990 A1 9/2008 Fox
2009/0312196 A1 12/2009 Colbeck et al.
2012/0214208 A1 8/2012 Patrick et al.
2014/0187447 A1 7/2014 Kucera et al.
2015/0010525 A1 1/2015 Wells et al.
2016/0186164 A1 6/2016 Christians
2016/0244787 A1 8/2016 Chan et al.
2017/0226498 A1 8/2017 Zheng et al.
2018/0320162 A1 11/2018 Miller et al.

FOREIGN PATENT DOCUMENTS

WO 96/00787 1/1996
WO 97/00078 1/1997
WO 97/35966 10/1997
WO 98/27230 6/1998
WO 00/42651 7/2000
WO 01/75767 A2 10/2001
WO 2009/152336 A1 12/2009
WO 2010/144103 A1 12/2010
WO 2011/034449 A1 3/2011
WO 2014/145269 A1 9/2014

OTHER PUBLICATIONS

S. L. Beaucage, et al., "Deoxynucleoside Phosphoramidites—A New Class of Key Intermediates for Deoxypolynucleotide Synthesis," Tetrahedron Letters 22(20):1859-1862 (1981).

Margaret E. Black, et al., "Creation of drug-specific herpes simplex virus type 1 thymidine kinase mutants for gene therapy," Proc. Natl. Acad. Sci. USA 93:3525-3529 (1996).

David Botstein, et al., "Strategies and Applications of in Vitro Mutagenesis," Science 229(4719):1193-1201 (1985).

Desmond R. Bullard, et al., "Direct comparison of nick-joining activity of the nucleic acid ligases from bacteriphage T4," Biochem. J. 398:135-144 (2006).

R. Craig Cadwell, et al., "Mutagenic PCR," Manual Supplement: PCR Methods and Applications (2003).

Paul Carter, "Site-directed mutagenesis," Biochem. J. 237:1-7 (1986).

Fred C. Christians, et al., "Directed evolution of thymidine kinase for AZT phosphorylation using DNA family shuffling," Nature Biotechnology 17:259-264 (1999).

Andreas Crameri, et al., "Improved Green Fluorescent Protein by Molecular Evolution Using DNA Shuffling," Nature Biotechnology 14:315-319 (1996).

Andreas Crameri, et al., "Molecular evolution of an arsenate detoxification pathway by DNA shuffling," Nature Biotechnology 15:436-438 (1997).

Andreas Crameri, et al., "DNA shuffling of a family of genes from diverse species accelerates directed evolution," Nature 391:288-291 (1998).

S. J. Dale, et al., "Oligonucleotide-directed random mutagenesis using the phosphorothioate method," Methods Mol. Biol. 57:369-374 (1996).

Herman A. De Boer, et al., "The tac promoter: A functional hybrid derived from the trp and lac promoters," Proc. Natl. Acad. Sci. USA 80:21-25 (1983).

Zijian Guo, et al., "3'-end-forming signals of yeast mRNA," Molecular and Cellular Biology 15(11):5983-5990 (1995).

Steven Henikoff, et al., "Amino acid substitution matrices from protein blocks," Proc. Natl. Acad. Sci. USA 89:10915-10919 (1992).

Saiful Islam, "Efficient ligation of DNA on RNA templates using a mutated T4 DNA ligase," Uppsala Universitet Masters Thesis (2008).

Barbara Kramer, et al., "Different Base/Base Mismatches Are Corrected with Different Efficiencies by the Methyl-Directed DNA Mismatch-Repair System of *E. coli*," Cell 38:879-887 (1984).

Michael Mingfu Ling, et al., "Approaches to DNA Mutagenesis: An Overview," Analytic Biochemistry 254:157-178 (1997).

Ichiro Matsumura, "Why Johnny can't clone: Common pitfalls and not so common solutions," BioTechniques 59: IV-XIII (2015).

Hans W.D. Matthes, et al., "Simultaneous rapid chemical synthesis of over one hundred oligonucleotides on a microscale," The EMBO Journal 3(4):801-805 (1984).

Jeremy Minshull, et al., "Protein evolution by molecular breeding," Current Opinion in Chemical Biology 3:284-290 (1999).

Saul B. Needleman, et al., "A General Method Applicable to the Search for Similarities in the Amino Acid Sequence of Two Proteins," J. Mol. Biol. 48:443-453 (1970).

(56) References Cited

OTHER PUBLICATIONS

William R. Pearson, et al., "Improved tools for biological sequence comparison," Proc. Natl. Acad. Sci. USA 85:2444-2448 (1988).
Barbara H. Pheiffer, et al., "Polymer-stimulated ligation: enhanced blunt- or cohesive-end ligation of DNA or deoxyribooligonucleotides by T4 DNA ligase in polymer solutions," Nucleic Acids Research 11(22):7853-7871 (1983).
Michael A. Romanos, et al., "Foreign Gene Expression in Yeast: a Review," Yeast 8:423-488 (1992).
Stewart Shuman, et al., "Covalent catalysis in nucleotidyl transfer reactions: Essential motifs in *Saccharomyces cerevisiae* RNA capping enzyme are conserved in Schizosaccharomyces pombe and viral capping enzymes and among polynucleotide ligases," Proc. Natl. Acad. Sci. USA 91:12046-12050 (1994).
Marjo Simonen, et al., "Protein Secretion in Bacillus Species," Microbiological Reviews 57(1):109-137 (1993).
Temple F. Smith, et al., "Comparison of Biosequences," Advances in Applied Mathematics 2:482-489 (1981).
Michael Smith, "In Vitro Mutagenesis," Ann. Rev. Genet. 19:423-462 (1985).
Willem P. C. Stemmer, "DNA shuffling by random fragmentation and reassembly: In vitro recombination for molecular evolution," Proc. Natl. Acad. Sci. USA 91:10747-10751 (1994).
Willem P. C. Stemmer, "Rapid evolution of a protein in vitro by DNA shuffling," Nature 370:389-391 (1994).
Fumio Takahashi, et al., "Activity-based in vitro selection of T4 DNA ligase," Biochemical and Biophysical Research Communications 336:987-993 (2005).
Uniprot, Accession No. A0A0A7HC26 (rest.uniprot.org/uniprotkb/A0A0A7HC26.txt).
Uniprot, Accession No. A0A097J5X7 (rest.uniprot.org/unisave/A0A097J5X7?from=A0A097J5X7&versions=9&format=txt).
Uniprot, Accession No. E3SF16.
Uniprot, Accession No. P19088 (rest. uniprot.org/unisave/P19088?fromP19088&versions=72&format=txt).
Lydia Villa-Komaroff, et al., "A bacterial clone synthesizing proinsulin," Proc. Natl. Acad. Sci. USA 75 (8):3727-3731 (1978).
James A. Wells, et al., "Cassette mutagenesis: an efficient method for generation of multiple mutations at defined sites," Gene 34:315-323 (1985).
Robert H. Wilson, et al., "Engineered DNA ligases with improved activities in vitro," Protein Engineering, Design & Selection 26(7):471-478 (2013).
Ji-Hu Zhang, et al., "Directed evolution of a fucosidase from a galactosidase by DNA shuffling and screening," Proc. Natl. Acad. Sci. USA 94:4504-4509 (1997).
Huimin Zhao, et al., "Molecular evolution by staggered extension process (StEP) in vitro recombination," Nature Biotechnology 16:258-261 (1998).

* cited by examiner

ENGINEERED DNA LIGASE VARIANTS

CROSS-REFERENCE TO RELATED APPLICATIONS

This application claims the benefit of U.S. Provisional Application No. 63/481,158, filed Jan. 23, 2023, which is incorporated by reference herein in its entirety.

REFERENCE TO SEQUENCE LISTING, TABLE OR COMPUTER PROGRAM

The instant application contains a Sequence Listing which has been submitted electronically in XML file format and is hereby incorporated by reference in its entirety. The XML copy, created on Apr. 25, 2024, is named P39238-US1_SL.xml and is 2,708,893 bytes in size.

TECHNICAL FIELD

The present disclosure provides engineered DNA ligase polypeptides and compositions thereof, polynucleotides encoding the engineered DNA ligase polypeptides, and methods of using the engineered DNA ligase, such as for the synthesis of polynucleotides, molecular biological tools, and in diagnostic applications.

BACKGROUND

DNA ligases are a family of enzymes that catalyze the covalent joining of DNA molecules by catalyzing the formation of a phosphodiester bond between 3' hydroxyl end of one DNA substrate and the 5' phosphorylated end of another DNA substrate. DNA ligases are involved in maintaining genome integrity by repairing single-strand breaks in duplex DNA during replication, repair, and recombination. Some ligases, such as T4 phage and eukaryotic DNA ligases, use ATP while other ligases, such as *E. coli* ligase, use NAD as a cofactor. DNA ligases can join dsDNA fragments having fully base paired, blunt ends or at ends with complementary single stranded overhangs. DNA ligases have found great utility in molecular biology and diagnostic applications, including restriction enzyme cloning, adaptor ligation for cloning/sequencing, SNP or sequence analysis, and assembling of DNA fragments from multiple smaller fragments.

A prototypical DNA ligase is from bacteriophage T4, which is the ligase most commonly used in molecular biological and diagnostic applications. T4 DNA ligase can ligate cohesive or "sticky" ends of DNA, oligonucleotides, as well as some RNA and RNA-DNA hybrids. It can also ligate blunt-ended DNA with high efficiency. T4 DNA ligase uses ATP as a cofactor. T4 DNA ligase is typically active between 4° C. and 37° C. but loses activity at higher temperature. T4 DNA ligase is also sensitive to buffer additives such as monovalent salts, which inhibit activity, especially end-joining activity. Moreover, T4 DNA ligase is biased to the sequence of the ultimate and penultimate base of the ligation site. Thus, while T4 DNA ligase has become an important tool for ligating DNA molecules in research and diagnostic applications, desirable are ligases that provide more facile and efficient ligation of DNA substrates.

SUMMARY

The present disclosure provides engineered DNA ligase polypeptides and compositions thereof, as well as polynucleotides encoding the engineered DNA ligase polypeptides. The present disclosure also provides methods of using the engineered DNA ligase polypeptides and compositions thereof for ligating polynucleotides.

In one aspect, the present disclosure provides an engineered DNA ligase, or a functional fragment thereof, comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 437 of an even-numbered SEQ ID NO. of SEQ ID NOs: 2 and 40-1184, or to a reference sequence corresponding to an even-numbered SEQ ID NO. of SEQ ID NOs: 2 and 40-1184, wherein the amino acid sequence comprises one or more substitutions relative to a reference sequence corresponding to residues 12 to 437 of SEQ ID NO: 2, 62, 138, 318, 722, or 938, or relative to a reference sequence corresponding to SEQ ID NO: 2, 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 437 of SEQ ID NO: 2, 62, 138, 318, 722, or 938, or to a reference sequence corresponding to SEQ ID NO: 2, 62, 138, 318, 722, or 938, wherein the amino acid sequence comprises one or more substitutions relative to the reference sequence corresponding to residues 12 to 437 of SEQ ID NO: 2, 62, 138, 318, 722, or 938, or relative to the reference sequence corresponding to SEQ ID NO: 2, 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 2, or to the reference sequence corresponding to SEQ ID NO: 2, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the engineered DNA ligase comprises an amino acid sequence having at least at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the engineered DNA ligase comprises an amino acid sequence having at least at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 11, 12, 13, 14, 18, 30, 31, 33, 34, 36, 37, 44, 50, 56, 59, 60, 61, 63, 67, 68, 69, 71, 73, 74, 76, 77, 82, 88, 95, 96, 97, 99, 100, 101, 102, 103, 104, 105, 106, 110, 112, 113, 117, 125, 128, 130, 132, 138, 139, 148, 149, 150, 155, 156, 159, 161, 162, 164, 165, 177, 186, 188, 189, 190, 191, 195, 196, 197, 198, 201, 205, 207, 208, 212, 220, 226, 228, 230, 231, 232, 233, 235, 237, 239, 240, 242, 251, 254, 258, 263, 264, 266, 267, 269, 271, 273, 277, 278, 282, 283, 284, 286, 288, 289, 290, 294, 295, 297, 300, 301, 305, 306, 308, 309, 317, 323, 328, 334, 337, 339, 349, 355, 356, 357, 358, 359, 360, 362, 364, 367, 370, 372, 374, 375, 378, 379, 380, 381, 382, 384, 386, 387, 388, 389, 390, 392, 396, 397, 404, 405, 408, 414, 415, 416, 417, 418, 419, 421, 422, 423, or 428, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or an amino acid residue 11D, 12A/I, 13G/R, 14G/S/T/V, 18D/N/S, 30C/H/S, 31R, 33M/R/V, 34L/R, 36T/Y, 37G/L/N/S, 44S, 50G/I/S/T, 56P, 59E, 60Y, 61T/V, 63F/R, 67R, 68A/M/S/V/Y, 69T, 71G/L/P/R, 73C/K/P/T/V/W, 74S, 76F/G/H/L/N/R, 77D, 82R, 88V, 95A/L/R/V, 96A/G/T/V, 97G, 99G/I, 100V, 101R, 102G/K/L/S, 103V, 104K, 105K/S/T, 106L/S/V, 110R, 112M, 113A/T, 117G/S/V/Y, 125R/T, 128C, 130T, 132R, 138L/R, 139T, 148P, 149P, 150C/F/T, 155R, 156C, 159Q, 161R/V, 162W, 164A/R, 165K, 177G, 186A/C/E/H/L/M/R/T/V, 188A, 189C/T, 190R, 191T, 195R, 196E/V, 197R, 198A/D/K/L/N/R/V/W, 201L/S, 205E/G/K, 207L, 208D/F/H, 212F/G/M/S/W, 220V, 226D/E/Q/S/V, 228E/I/M/S, 230L/M, 231P, 232R, 233G/T/W, 235W, 237L/M/R/S/V/Y, 239M/N/P/Q/S/T/V/W, 240E/G/K/Q/R/S/Y, 242P/Q/T, 251L, 254G/S, 258L/S/V, 263G/L/Q/T, 264A/C, 266M/T, 267D/W/Y, 269L, 271A/G/N/S, 273A/G/S, 277Q/R, 278E, 282G/L/M/T/V/Y, 283A/G/K/L/M/R/S/V, 284D, 286F/L/S, 288L, 289A/L/S/V, 290L, 294L, 295K, 297W, 300G/T, 301F/L, 305K, 306I/K/SN, 308K/L/S, 309G/R, 317Q, 323S, 328R, 334L/R, 337G/L/M/P/R/S, 339Y, 349E, 355S, 356A/V/W, 357H/K/P/R/S/V, 358C, 359N/R, 360H/MIP, 362G, 363R, 364R, 367C/L, 370C/G, 372N/Q, 374A/S, 375W, 378T, 379A/G/P, 380T, 381K/R, 382V, 384C/V, 386F, 387G, 388K/Y, 389K/L/Q/R, 390E, 392C/I/K/L/R/S, 396C/H, 397K/L/M, 404S, 405I, 408C/V, 414A/L/Q/R/T/V, 415A/C/E/H/I/K/L/V, 416K, 417D/G/L, 418A/G/I/L/M/P/S/T, 419G, 421R, 422N, 423R/T, or 428F/R/S, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) 233, 317, 191, 288, 207, 149, 251, 205, 269, 164, 36, 428, 105/132, or 105, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least one substitution set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to SEQ ID NO: 2.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence comprising at least a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to a reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938, wherein the amino acid sequence comprises one or more substitutions relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184, wherein the amino acid sequence comprises one or more substitutions relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution at amino acid position 11, 12, 13, 14, 18, 30, 31, 33, 34, 36, 37, 44, 50, 56, 59, 60, 61, 63, 67, 68, 69, 71, 73, 74, 76, 77, 82, 88, 95, 96, 97, 99, 100, 101, 102, 103, 104, 105, 106, 110, 112, 113, 117, 125, 128, 130, 132, 138, 139, 148, 149, 150, 155, 156, 159, 161, 162, 164, 165, 177, 186, 188, 189, 190, 191, 195, 196, 197, 198, 201, 205, 207, 208, 212, 220, 226, 228, 230, 231, 232, 233, 235, 237, 239, 240, 242, 251, 254, 258, 263, 264, 266, 267, 269, 271, 273, 277, 278, 282, 283, 284, 286, 288, 289, 290, 294, 295, 297, 300, 301, 305, 306, 308, 309, 317, 323, 328, 334, 337, 339, 349, 355, 356, 357, 358, 359, 360, 362, 364, 367, 370, 372, 374, 375, 378, 379, 380, 381, 382, 384, 386, 387, 388, 389, 390, 392, 396, 397, 404, 405, 408, 414, 415, 416, 417, 418, 419, 421, 422, 423, or 428, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution or an amino acid residue I1D, 12A/I, 13G/R, 14G/S/T/V, 18D/N/S, 30C/H/S, 31R, 33M/R/V, 34L/R, 36T/Y, 37G/L/N/S, 44S, 50G/I/S/T, 56P, 59E, 60Y, 61T/V, 63F/R, 67R, 68A/M/S/V/Y, 69T, 71G/L/P/R, 73C/K/P/T/V/W, 74S, 76F/G/H/L/N/R, 77D, 82R, 88V, 95A/L/R/V, 96A/G/T/V, 97G, 99G/I, 100V, 101R, 102G/K/L/S, 103V, 104K, 105K/S/T, 106L/S/V, 110R, 112M, 113A/T, 117G/S/V/Y, 125R/T, 128C, 130T, 132R, 138L/R, 139T, 148P, 149P, 150C/F/T, 155R, 156C, 159Q, 161R/V, 162W, 164A/R, 165K, 177G, 186A/C/E/H/L/M/R/T/V, 188A, 189C/T, 190R, 191T, 195R, 196E/V, 197R, 198A/D/K/L/N/R/V/W, 201L/S, 205E/G/K, 207L, 208D/F/H, 212F/G/M/S/W, 220V, 226D/E/Q/S/V, 228E/I/M/S, 230L/M, 231P, 232R, 233G/T/W, 235W, 237L/M/R/S/V/Y, 239M/N/P/Q/S/T/V/W, 240E/G/K/Q/R/S/Y, 242P/Q/T/V, 251L, 254G/S, 258L/S/V, 263G/L/Q/T, 264A/C, 266M/T, 267D/W/Y, 269L, 271A/G/N/S, 273A/G/S, 277Q/R, 278E, 282G/L/M/T/V/Y, 283A/F/G/K/L/M/R/S/V, 284D, 286F/L/S/W, 288I, 289A/L/S/V, 290L, 294L, 295K, 297W, 300G/T, 301F/L, 305K, 306I/K/SN, 308K/L/S, 309G, 317T/Q, 323S, 328R, 334L/R, 337G/L/M/P/R/S, 339Y, 349E, 355S, 356A/V/W, 357H/K/P/R/S/V, 358C, 359N/R, 360H/M/P, 362G, 364R, 367C/L, 370C/G, 372N/Q, 374A/S, 375W, 378T, 379A/G/P, 380T, 381K/R, 382V, 384C/V, 386F, 387G, 388K/Y, 389K/L/Q/R, 390E, 392C/I/K/L/R/S, 396C/H, 397K/L/M, 404S, 405I, 408C/V, 414A/L/Q/R/S/T/V, 415A/C/E/H/I/K/L/V, 416K, 417D/G/L, 418A/G/I/K/L/M/P/S/T, 419G, 421R, 422N, 423R/T, or 428E/F/R/S, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution at amino acid position 63, 242, 283, 286, 317, 414, 418, or 428, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution or an amino acid residue 63R, 242Q, 283L, 286S, 317Q, 414Q, 418S, or 428R, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, or to the reference sequence corresponding to SEQ ID NO: 62, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 68-312, or to the reference sequence corresponding to an even-numbered SEQ ID NO. of SEQ ID NOs: 68-312, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the amino acid sequence of the engineered DNA ligase comprises at least a substitution or substitution set at amino acid position(s) 196, 242, 337, 33, 277, 30, 359, 283, 415, 387, 379, 205, 186, 389, 102, 164, 301, 375, 267, 380, 254, 317, 77/139/317/417, 105/317/417, 317/349/362/386, 105/317, 139/317/362, 233/317/405, 139/317, 162, 286, 414, 417, 226, 61, 105, 230, 418, 370, 297, 237, 428, 362, 233, 235, 148, 100, 97, 382, or 358, wherein the amino acid positions are relative to the reference sequence corresponding to residues 12 to 437 of SEQ ID NO: 62, or relative to the reference sequence corresponding to SEQ ID NO: 62.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 138, or to the reference sequence corresponding to SEQ ID NO: 138, wherein the amino acid sequence comprises one or more substitutions relative to the reference sequence corresponding to residues 12 to 437 of SEQ ID NO: 138, or relative to the reference sequence corresponding to SEQ ID NO: 138.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 314-458, or to the reference sequence corresponding to an even-numbered SEQ ID NO. of SEQ ID NOs: 314-458, wherein the amino acid sequence comprises one or more substitutions relative to the reference sequence corresponding to residues 12 to 437 of SEQ ID NO: 138, or relative to the reference sequence corresponding to SEQ ID NO: 138.

In some embodiments, the amino acid sequence of the engineered DNA ligase comprises at least a substitution or substitution set at amino acid position(s) 242/283/286/359/418, 283/286, 283/286/418, 186/242/283/286/418, 205/286/359, 283, 242/286/418, 186/205/242, 283/286/359, 277/286/359/418, 186/205/283/286/359, 242/277/418, 242/283/286/418, 112/196/389, 286, 283/286/359/418, 242/359/418, 186/283, 186/359/418, 205/242/418, 186/205/242/283/286/359/418, 205/359/418, 186/205/283/286/418, 186/283/359, 186/242, 186/242/359, 283/359/418, 277/418, 186/188/283, 186/286/418, 186/242/286/359/418, 418, 186/242/283/286/359/

418, 186/277/359/418, 242/283/286, 205/418, 30/297, 205/242/286/359/418, 186/205/359/418, 359/418, 186, 230, 33/297, 186/205, 186/283/359/418, 186/418, 205/242/283/359/418, 33/375/389, 33/230, 196/242/283/286/359/418, 186/242/283/359/418, 186/359, 33/196, 186/277/418, 242, 33/196/297/301, 205/237/242/283/286/359, 186/205/283/359/418, 33/389, or 186/196/242/283/286/359/418, wherein the amino acid positions are relative to the reference sequence corresponding to residues 12 to 437 of SEQ ID NO: 138, or relative to the reference sequence corresponding to SEQ ID NO: 138.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 318, or to the reference sequence corresponding to SEQ ID NO: 318, wherein the amino acid sequence comprises one or more substitutions relative to the reference sequence corresponding to residues 12 to 437 of SEQ ID NO: 318, or relative to the reference sequence corresponding to SEQ ID NO: 318.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 460-936, or to the reference sequence corresponding to an even-numbered SEQ ID NO. of SEQ ID NOs: 460-936, wherein the amino acid sequence comprises one or more substitutions relative to the reference sequence corresponding to residues 12 to 437 of SEQ ID NO: 318, or relative to the reference sequence corresponding to SEQ ID NO: 318.

In some embodiments, the amino acid sequence of the engineered DNA ligase comprises at least a substitution or substitution set at amino acid position(s) 363, 63, 389, 381, 197, 359, 102, 165, 388, 414, 337, 164, 416, 101, 415, 423, 364, 73, 50, 71, 388/419, 357, 396, 68, 76, 14, 271, 360, 266, 208, 74, 263, 264, 13, 378, 372, 300, 294, 290, 397, 95, 258, 161, 212, 198, 138, 18, 404, 273, 117, 240, 69, 278, 289, 82, 328, 61/186/417, 186/370/417, 267, 61/370, 186/267/370/417, 61/186, 370/417, 417, 61/370/382, 61/186/267/370/417, 61, 267/370/417, 267/370, 61/417, 61/186/237/267/370, 61/237/370/417, 370, 186/370, 61/186/267/417, 61/186/370/382, 370/382/417, 61/186/370, 237/267/370/417, 61/186/382, 61/267, 61/267/417, 61/237/267/382, 186/370/382, 237/267/370, 61/186/267/370, 186/237/267/370, 61/186/267, 61/186/237, 186, 186/267, 237/370/417, 242/414, 162/414, 267/414, 105/414, 162/242/414, 97/162/414, 105/162/267/414, 356, 392, 106, 308, 306, 96, 282, 113, 309, 110, 37, 201, 284, 374, 295, 88, 44, 12, or 390, wherein the amino acid positions are relative to the reference sequence corresponding to residues 12 to 437 of SEQ ID NO: 318, or relative to the reference sequence corresponding to SEQ ID NO: 318.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 722, or to the reference sequence corresponding to SEQ ID NO: 722, wherein the amino acid sequence comprises one or more substitutions relative to the reference sequence corresponding to residues 12 to 437 of SEQ ID NO: 722, or relative to the reference sequence corresponding to SEQ ID NO: 722.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 938-1098, or to the reference sequence corresponding to an even-numbered SEQ ID NO. of SEQ ID NOs: 938-1098, wherein the amino acid sequence comprises one or more substitutions relative to the reference sequence corresponding to residues 12 to 437 of SEQ ID NO: 722, or relative to the reference sequence corresponding to SEQ ID NO: 722.

In some embodiments, the amino acid sequence of the engineered DNA ligase comprises at least a substitution or substitution set at amino acid position(s) 63, 63/96/370, 389, 13/267/363/389, 13/186/389, 50/267/363/370/389, 363/370, 96/370, 61/63/212, 11/305, 11, 242/283/286/317/414/418, 323, 334, 339, 356, 384, 408, 67, 392, 104, 355, 159, 155, 367, 31, 231, 36, 150, 239, 103, 125, 228, 37, 189, 177, 422, 128, 220, 130, 56, 190, 156, 232, 423, 34, 99, 59, 60, 421, or 195, wherein the amino acid positions are relative to the reference sequence corresponding to residues 12 to 437 of SEQ ID NO: 722, or relative to the reference sequence corresponding to SEQ ID NO: 722.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 938, or to the reference sequence corresponding to SEQ ID NO: 938, wherein the amino acid sequence comprises one or more substitutions relative to the reference sequence corresponding to residues 12 to 437 of SEQ ID NO: 938, or relative to the reference sequence corresponding to SEQ ID NO: 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 1100-1184, or to the reference sequence corresponding to an even-numbered SEQ ID NO. of SEQ ID NOs: 1100-1184, wherein the amino acid sequence comprises one or more substitutions relative to the reference sequence corresponding to residues 12 to 437 of SEQ ID NO: 938, or relative to the reference sequence corresponding to SEQ ID NO: 938.

In some embodiments, the amino acid sequence of the engineered DNA ligase comprises at least a substitution or substitution set at amino acid position(s) 308/357/390, 74/76/201/308/357, 61/74/76/186/201/308/309/357/390, 14/201/240/289/357, 308/415, 76/357/396, 263/308/396, 61/76/96/240/308/309, 14/306/415, 14/73/106/415, 12/14/258/263/289/308/309/396, 74/76/117/309/357, 14/258/263/357/396, 14/96/106/306, 14/106, 12/14/308/309, 14/357/390, 14/117/258/309/357, 390, 240/273/357/390, 61/76/186/201/308/309, 14/396, 309, 14, 106/306/308, 14/240/306/308, 12/14/186/357, 309/390, 14/306, 14/76/308, 117/208/258/263/289/308/309, 14/73/106, 76/208/263, 357, 14/308, 263, 76, 14/300/308/415, 240, 33/357/390, 14/76/273, or 74, wherein the amino acid positions are relative to the reference sequence corresponding to residues 12 to 437 of SEQ ID NO: 938, or relative to the reference sequence corresponding to SEQ ID NO: 938.

In some embodiments, the amino acid sequence of the engineered DNA ligase comprises at least one substitution set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence comprising at least a substitution or substitution set provided in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence comprising residues 12 to 437 of an engineered DNA ligase variant set forth in Tables 9.2, 10.2, 11.2, 12.2, 13.2, 14.2, 15.2, 16.2, 17.2, and 18.2, or a sequence comprising an engineered DNA ligase variant set forth in Tables 9.2, 10.2, 11.2, 12.2, 13.2, 14.2, 15.2, 16.2, 17.2, and 18.2.

In some embodiments, the engineered DNA ligase comprises an amino acid sequence comprising residues 12 to 437 of an even numbered SEQ ID NO. of SEQ ID NOs: 40-1184, or an amino acid sequence comprising an even numbered SEQ ID NO. of SEQ ID NOs: 40-1184, optionally wherein the amino acid sequence has 1, 2, 3, 4, 5, 6, 7, 8, 9, or up to 10 substitutions.

In some embodiments, the engineered DNA ligase comprises an amino acid sequence comprising residues 12 to 437 of SEQ ID NO: 62, 138, 318, 722, 938, or 1108, or an amino acid sequence comprising SEQ ID NO: 62, 138, 318, 722, 938 or 1108, optionally wherein the amino acid sequence has 1, 2, 3, 4, 5, 6, 7, 8, 9, or up to 10 substitutions in the amino acid sequence.

In some embodiments, the engineered DNA ligase has DNA ligase activity. In some embodiments, the engineered DNA ligase has DNA ligase activity and is characterized by at least one improved property as compared to a reference DNA ligase. In some embodiments, the improved property of the engineered DNA ligase is selected from i) increased activity, ii) increased stability, iii) increased thermostability, iv) increased product yield, v) increased solubility, vi) reduced sequence bias, and vii) insensitivity or reduced sensitivity to input DNA concentrations, or any combination of i), ii), iii), iv), v), vi), and vii) compared to a reference DNA ligase. In some embodiments, the improved property of the engineered DNA ligase is in comparison to the reference DNA ligase having the sequence corresponding to residues 12 to 437 of SEQ ID NO: 2, 62, 138, 318, 722, or 938, or the sequence corresponding to SEQ ID NO: 2, 62, 138, 318, 722, or 938. In some embodiments, the improved property of the engineered DNA ligase is in comparison to the reference DNA ligase having the sequence corresponding to residues 12 to 437 of SEQ ID NO: 2, or the sequence corresponding to SEQ ID NO: 2. In some embodiments, the reference DNA ligase is wild-type T4 DNA ligase.

In some further embodiments, the engineered DNA ligase is purified. In some embodiments, the engineered DNA ligase is provided in solution, as a lyophilizate, or is immobilized on a substrate, such as a solid substrate, porous substrate, membrane, or particle.

In another aspect, the present disclosure provides a recombinant polynucleotide comprising a polynucleotide sequence encoding an engineered DNA ligase disclosed herein.

In some embodiments, the recombinant polynucleotide comprises a polynucleotide sequence having at least 70%, 75%, 75%, 80%, 81%, 82%, 83%, 84%, 85%, 90%, 91%, 92%, 93%, 94%, 95%, 96%, 97%, 98%, 99%, or more sequence identity to a reference polynucleotide sequence corresponding to nucleotide residues 34 to 1311 of SEQ ID NO: 1, 61, 137, 317, 721, or 937, or to a reference polynucleotide sequence corresponding to SEQ ID NO: 1, 61, 137, 317, 721, or 937, wherein the recombinant polynucleotide encodes an engineered DNA ligase.

In some embodiments, the recombinant polynucleotide comprises a polynucleotide sequence having at least 70%, 75%, 80%, 81%, 82%, 83%, 84%, 85%, 90%, 91%, 92%, 93%, 94%, 95%, 96%, 97%, 98%, 99%, or more sequence identity to a reference polynucleotide sequence corresponding to nucleotide residues 34 to 1311 of an odd numbered SEQ ID NO. of SEQ ID NOs: 39-1183, or to a reference polynucleotide sequence corresponding to an odd numbered SEQ ID NO. of SEQ ID NOs: 39-1183, wherein the recombinant polynucleotide encodes an engineered DNA ligase.

In some embodiments, the polynucleotide sequence of the recombinant polynucleotide encoding an engineered DNA ligase is codon optimized for expression in an organism or cell type thereof, for example a bacterial cell, fungal cell, insect cell, or mammalian cell.

In some embodiments, the recombinant polynucleotide comprises a polynucleotide sequence comprising nucleotide residues 34 to 1311 of SEQ ID NO. 1, 61, 137, 317, 721, or 937, or a polynucleotide sequence comprising SEQ ID NO: 1, 61, 137, 317, 721, or 937.

In some embodiments, the recombinant polynucleotide comprises a polynucleotide sequence comprising nucleotide residues 34 to 1311 of an odd numbered SEQ ID NO. of SEQ ID NOs: 39-1183, or a polynucleotide sequence comprising an odd numbered SEQ ID NO. of SEQ ID NOs: 39-1183.

In a further aspect, the present disclosure provides expression vectors comprising a recombinant polynucleotide provided herein encoding an engineered DNA ligase. In some embodiments, the recombinant polynucleotide of the expression vector is operably linked to a control sequence. In some embodiments, the control sequence comprises a promoter, particularly a heterologous promoter.

In another aspect, the present disclosure also provides a host cell comprising a recombinant polynucleotide or an expression vector provided herein. In some embodiments, the host cell is a prokaryotic cell or a eukaryotic cell. In some embodiments, the host cell is a bacterial cell, fungal cell, insect cell, or mammalian cell.

In a further aspect, the present disclosure provides a method of producing an engineered DNA ligase polypeptide, the method comprising culturing a host cell described herein under suitable culture conditions such that at least one engineered DNA ligase is produced. In some embodiments, the method further comprises recovering or isolating the engineered DNA ligase from the culture medium and/or host cells. In some embodiments, the method further comprises purifying the engineered DNA ligase.

In another aspect, the present disclosure provides a composition comprising at least one engineered DNA ligase disclosed herein. In some embodiments, the composition comprises at least a buffer. In some embodiments, the composition further comprises a nucleotide substrate (e.g., ATP) and/or one or more of DNA ligase substrates. In some embodiments, the DNA ligase substrate comprises an adapter or linker.

In a further aspect, the present disclosure provides a method of ligating at least a first DNA strand and a second DNA strand, comprising contacting a first DNA strand and a second DNA strand with an engineered DNA ligase described herein in presence of a nucleotide substrate under conditions suitable for ligation of the first DNA strand to the second DNA strand, wherein the first DNA strand comprises a ligatable 5'-end and the second DNA strand comprises a 3'-end ligatable to the 5'-end of the first DNA strand. In some embodiments, the 3'-end of the second DNA strand is a 3'-hydroxyl and the 5'-end of the first DNA strand is a 5'-phosphate.

In some embodiments, the method further comprises a third DNA or polynucleotide strand, wherein the first DNA strand and second DNA strand hybridize adjacent to one another on the third DNA or polynucleotide strand to position the 5'-end of the first DNA strand adjacent to the 3'-end of the second DNA strand. In some embodiments, the third DNA or polynucleotide strand is continuous with the first DNA strand or second DNA strand. In some embodiments, the third DNA strand is continuous with the first DNA strand and second DNA strand to form a single continuous DNA ligase substrate.

In some embodiments of the method, the first DNA strand is hybridized to a third DNA strand to form a first dsDNA substrate, and the second DNA strand is hybridized to a fourth DNA strand form a second dsDNA substrate. In some embodiments, the first dsDNA substrate comprises a blunted ended 5' end of the first DNA strand, and the second dsDNA substrate comprises a blunt ended 3'-end of the second DNA strand.

In some embodiments of the method, the first dsDNA substrate comprises an overhang on at one least end of the first dsDNA substrate, and the second dsDNA substrate comprises an overhang on at least one end of the second dsDNA substrate, wherein the overhang on the first dsDNA substrate and overhang on the second dsDNA substrate are complementary and capable of hybridizing to each other and form a nick or nicks that can be ligated.

In a further aspect, the present disclosure also provides a kit comprising at least one engineered DNA ligase disclosed herein. In some embodiments, the kits further comprises one or more of a buffer, nucleotide substrate, reducing agent, one or more DNA ligase substrates, and/or ligation enhancing agent.

DETAILED DESCRIPTION

The present disclosure provides engineered DNA ligase polypeptides and compositions thereof, and polynucleotides encoding the engineered DNA ligase polypeptides. The disclosure also provides methods of using of the engineered DNA ligase polypeptides and compositions thereof for molecular biological, diagnostic, and other purposes. In some embodiments, the engineered DNA ligase polypeptides display, among others, increased activity, increased stability, increased thermal stability, increased solubility and/or reduced sequence bias.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art.

Although any suitable methods and materials similar or equivalent to those described herein find use in the practice of the present invention, exemplary methods and materials are described herein. It is to be understood that the present invention is not limited to the particular methodology, protocols, and reagents described, as these may vary, depending upon the context they are used by those of skill in the art. Accordingly, the terms defined immediately below are more fully described by reference to the application as a whole.

As used herein, the singular "a", "an," and "the" include the plural references, unless the context clearly indicates otherwise.

As used herein, the term "comprising" and its cognates are used in their inclusive sense (i.e., equivalent to the term "including" and its corresponding cognates).

It is also to be understood that where description of embodiments use the term "comprising" and its cognates, the embodiments can also be described using language "consisting essentially of" or "consisting of."

Moreover, numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used herein, the term "about" means an acceptable error for a particular value. In some instances, "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole.

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. The abbreviations used for the genetically encoded amino acids are conventional and are as follows: alanine (Ala or A), arginine (Arg or R), asparagine (Asn or N), aspartate (Asp or D), cysteine (Cys or C), glutamate (Glu or E), glycine (Gly or G), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V). When the three-letter abbreviations are used, unless specifically preceded by an "L" or a "D" or clear from the context in which the abbreviation is used, the amino acid may be in either the L- or D-configuration about α-carbon (Cα). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

"Fusion protein," and "chimeric protein" and "chimera" refer to hybrid proteins created through the joining of two or more polynucleotides that originally encode separate proteins. In some embodiments, fusion proteins are created by recombinant technology.

"DNA ligase" refers to enzymes that covalently join the 5'-phosphoryl termini ("donor") and 3'-hydroxyl termini ("acceptor") of DNA to each other. DNA ligases can be grouped into two families based on cofactor requirements: ATP-dependent ligases and NAD+-dependent ligases. DNA ligases of eukaryl and archael organisms are generally ATP-dependent. DNA ligases of eubacterial origin are generally NAD+ dependent. DNA ligase include enzymes within the general class of EC 6.5.1.

"Polynucleotide," "nucleic acid," or "oligonucleotide" is used herein to denote a polymer comprising at least two nucleotides where the nucleotides are either deoxyribonucleotides or ribonucleotides or mixtures of deoxyribonucleotides and ribonucleotides. In some embodiments, the abbreviations used for genetically encoding nucleosides are conventional and are as follow: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When a polynucleotide, nucleic acid, or oligonucleotide sequences are presented as a string of one-letter abbreviations, the sequences are presented in the 5' to 3' direction in accordance with common convention, and the phosphates are not indicated. The term "DNA" refers to deoxyribonucleic acid. The term "RNA" refers to ribonucleic acid. The polynucleotide or nucleic acid may be single-stranded or double-stranded, or may include both single-stranded regions and double-stranded regions.

"Duplex" and "ds" refer to a double-stranded nucleic acid (e.g., DNA or RNA) molecule comprised of two single-stranded polynucleotides that are complementary in their sequence (A pairs to T or U, C pairs to G), arranged in an antiparallel 5' to 3' orientation, and held together by hydrogen bonds between the nucleobases (i.e., adenine [A], guanine [G], cytosine [C], thymine [T], uridine [U]).

"Complementary" is used herein to describe the structural relationship between nucleotide bases that are capable of forming base pairs with one another. For example, a purine nucleotide base present on a polynucleotide that is complementary to a pyrimidine nucleotide base on a polynucleotide may base pair by forming hydrogen bonds with one another. Complementary nucleotide bases can base pair via Watson/Crick base pairing or in any other manner than forms stable duplexes or other nucleic acid structures.

"Watson/Crick Base-Pairing" refers to a pattern of specific pairs of nucleobases and analogs that bind together through sequence-specific hydrogen-bonds, e.g., A pairs with T or U, and G pairs with C.

"Annealing" or "Hybridization" refers to the base-pairing interactions of one nucleobase polymer (e.g., poly- and oligonucleotides) with another that results in the formation of a double-stranded structure, a triplex structure or a quaternary structure. Annealing or hybridization can occur via Watson-Crick base-pairing interactions, but may be mediated by other hydrogen-bonding interactions, such as Hoogsteen base pairing. In some embodiments, the nucleobase polymer that anneals or hybridizes to another is a single nucleobase polymer while in other embodiments, the nucleobase polymers are separate nucleobase polymers.

"Engineered," "recombinant," "non-naturally occurring," and "variant," when used with reference to a cell, a polynucleotide or a polypeptide refer to a material or a material corresponding to the natural or native form of the material that has been modified in a manner that would not otherwise exist in nature or is identical thereto but produced or derived from synthetic materials and/or by manipulation using recombinant techniques.

"Wild-type" and "naturally-occurring" refer to the form found in nature. For example, a wild-type polypeptide or polynucleotide sequence is a sequence present in an organism that can be isolated from a source in nature and which has not been intentionally modified by human manipulation.

"Coding sequence" refers to that part of a nucleic acid (e.g., a gene) that encodes an amino acid sequence of a protein.

"Percent (%) sequence identity" refers to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences.

Optimal alignment of sequences for comparison can be conducted, e.g., by the local homology algorithm of Smith and Waterman (Smith and Waterman, Adv. Appl. Math., 1981, 2:482), by the homology alignment algorithm of Needleman and Wunsch (Needleman and Wunsch, J. Mol. Biol., 1970, 48:443), by the search for similarity method of Pearson and Lipman (Pearson and Lipman, Proc. Natl. Acad. Sci. USA, 1988, 85:2444), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms (see, e.g., Altschul et al., J. Mol. Biol., 1990, 215: 403-410; and Altschul et al., Nucleic Acids Res., 1977, 3389-3402). Software for performing BLAST analyses is publicly available through the National Center for Biotechnology Information website. This algorithm involves first identifying high scoring sequence pairs (HSPs) by identifying short words of length "W" in the query sequence, which either match or satisfy some positive-valued threshold score "T," when aligned with a word of the same length in a database sequence. T is referred to as the neighborhood word score threshold (see Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters "M" (reward score for a pair of matching residues; always >0) and "N" (penalty score for mismatching residues; always <0). For amino acid sequences, a scoring matrix is used to calculate the cumulative score. Extension of the word hits in each direction are halted when: the cumulative alignment score falls off by the quantity "X" from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see, e.g., Henikoff and Henikoff, Proc. Natl. Acad. Sci. USA, 1989, 89:10915). Exemplary determination of sequence alignment and % sequence identity can employ the BESTFIT or GAP programs in the GCG Wisconsin Software package (Accelrys, Madison WI), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, the phrase "a reference sequence corresponding to SEQ ID NO: 2, having an aspartic acid at the residue corresponding to X11" (or "a reference sequence corresponding to SEQ ID NO: 2, having an aspartic acid at the residue corresponding to position 11") refers to a reference sequence in which the corresponding residue at position X11 in SEQ ID NO: 2 (e.g., a glycine), has been changed to aspartic acid.

"Comparison window" refers to a conceptual segment of contiguous nucleotide positions or amino acids residues wherein a sequence may be compared to a reference sequence. In some embodiments, the comparison window is at least 15 to 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. In some embodiments, the comparison window can be longer than 15-20 contiguous residues, and includes, optionally 30, 40, 50, 100, or longer windows.

"Corresponding to", "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered DNA ligase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Mutation" refers to the alteration of a nucleic acid sequence. In some embodiments, mutations result in changes to the encoded polypeptide sequence (i.e., as compared to the original sequence without the mutation). In some embodiments, the mutation comprises a substitution, such that a different amino acid is produced. In some alternative embodiments, the mutation comprises an addition, such that an amino acid is added (e.g., insertion) to the original polypeptide sequence. In some further embodiments, the mutation comprises a deletion, such that an amino acid is deleted from the original polypeptide sequence. Any number of mutations may be present in a given sequence. In some embodiments, a "substitution" comprises the deletion of an amino acid, and where present, can be denoted by "–" symbol.

"Amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X14 as compared to SEQ ID NO: 2" (or a "residue difference at position 14 as compared to SEQ ID NO: 2") refers to a difference of the amino acid residue at the polypeptide position corresponding to position 14 of SEQ ID NO: 2. Thus, if the reference polypeptide of SEQ ID NO: 2 has a lysine at position 14, then a "residue difference at position X14 as compared to SEQ ID NO: 2" refers to an amino acid substitution of any residue other than lysine at the position of the polypeptide corresponding to position 14 of SEQ ID NO: 2. In some instances herein, the specific amino acid residue difference at a position is indicated as "XnY" where "Xn" specified the corresponding residue and position of the reference polypeptide (as described above), and "Y" is the single letter identifier of the amino acid found in the engineered polypeptide (i.e., the different residue than in the reference polypeptide). In some instances (e.g., in the Tables in the Examples), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some embodiments, the amino acid difference, e.g., a substitution, is denoted by the abbreviation "nB," without the identifier for the residue in the reference sequence. In some embodiments, the phrase "an amino acid residue nB" denotes the presence of the amino residue in the engineered polypeptide, which may or may not be a substitution in context of a reference polypeptide or amino acid sequence.

In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X12A/X12I, X12A/I, or 129A/I).

"Amino acid substitution set" and "substitution set" refers to a group of amino acid substitutions within a polypeptide sequence. In some embodiments, substitution sets comprise 2, 3, 4, 5, 6, 7, 8, 9, 10, 11, 12, 13, 14, 15, or more amino acid substitutions. In some embodiments, a substitution set refers to the set of amino acid substitutions that is present in any of the variant DNA ligase polypeptides listed in any of the Tables in the Examples. In these substitution sets, the individual substitutions are separated by a semicolon (";"; e.g., L105K; T317Q) or slash ("/"; e.g., L105K/T317Q or 105K/317Q).

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and a hydrophobic or hydrophilic amino acid is replaced with another hydrophobic or hydrophilic amino acid, respectively.

"Non-conservative substitution" refers to substitution of an amino acid in the polypeptide with an amino acid with significantly differing side chain properties. Non-conservative substitutions may use amino acids between, rather than within, the defined groups and affect: (a) the structure of the peptide backbone in the area of the substitution (e.g., proline for glycine); (b) the charge or hydrophobicity; and/or (c) the bulk of the side chain. By way of example and not limitation, exemplary non-conservative substitutions include an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered DNA ligase. Deletions can be directed to the internal portions and/or terminal portions of the polypeptide. In various embodiments, the deletion can comprise a continuous segment or can be discontinuous. In some embodiments, deletions are indicated by "–", and may be present in substitution sets.

"Insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Functional fragment" and "biologically active fragment" are used interchangeably herein, to refer to a polypeptide that has an amino-terminal and/or carboxy-terminal deletion (s) and/or internal deletions, but where the remaining amino acid sequence is identical to the corresponding positions in the sequence to which it is being compared (e.g., a full length engineered DNA ligase of the present disclosure) and that retains substantially all of the activity of the full-length polypeptide.

"Isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The engineered DNA ligase polypeptides may be present within a cell, present in the cellular medium, or prepared in various forms, such as lysates or isolated preparations.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight.

Generally, a substantially pure DNA ligase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant DNA ligase polypeptides are substantially pure polypeptide compositions.

"Improved enzyme property" refers to an engineered DNA ligase polypeptide that exhibits an improvement in any enzyme property as compared to a reference DNA ligase polypeptide, such as a wild-type DNA ligase polypeptide or another engineered DNA ligase polypeptide. Improved properties can include, but are not limited to, such properties as increased protein expression, increased thermoactivity, increased thermostability, increased stability, increased enzymatic activity, increased substrate specificity and/or affinity, increased substrate range, increased specific activity, increased resistance to substrate and/or end-product inhibition, increased chemical stability, improved solvent stability, increased solubility, and increased inhibitor resistance/tolerance.

"Increased enzymatic activity" and "enhanced catalytic activity" refer to an improved property of the engineered DNA ligase polypeptides, which can be represented by an increase in specific activity (e.g., product produced/time/weight protein) and/or an increase in percent conversion of the substrate to the product (e.g., percent conversion of starting amount of substrate to product in a specified time period using a specified amount of DNA ligase) as compared to the reference DNA ligase enzyme (e.g., wild-type DNA ligase and/or another engineered DNA ligase). Exemplary methods to determine enzyme activity are provided in the Examples. Any property relating to enzyme activity may be affected, including the classical enzyme properties of $K_m$, $V_m$ or $k_{cat}$, changes of which can lead to increased enzymatic activity. Improvements in enzyme activity can be from about 1.1 fold the enzymatic activity of the corresponding wild-type enzyme, to about 1.5 fold, 2-fold, 5-fold, 10-fold, 20-fold, 25-fold, 50-fold, 75-fold, 100-fold, 150-fold, 200-fold or more enzymatic activity than the naturally occurring DNA ligase or another engineered DNA ligase from which the DNA ligase polypeptides were derived.

"Hybridization stringency" relates to hybridization conditions, such as washing conditions, in the hybridization of nucleic acids. Generally, hybridization reactions are performed under conditions of lower stringency followed by washes of varying but higher stringency (see, e.g., Sambrook et al., Molecular Cloning: A Laboratory Manual, Cold Spring Harbor Laboratory Press, New York, 2001; Ausubel et al., Current Protocols in Molecular Biology, John Wiley & Sons, 2003). The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature T, as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition comprises hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in that organism. Although the genetic code is degenerate, in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the DNA ligase enzymes are codon optimized for optimal production from the host organism selected for expression.

"Control sequence" refers herein to include all components that are necessary or advantageous for the expression of a polynucleotide and/or polypeptide of the present disclosure. Each control sequence may be native or foreign to the nucleic acid sequence encoding the polypeptide. Such control sequences include, but are not limited to, leaders, polyadenylation sequences, propeptide sequences, promoter sequences, signal peptide sequences, initiation sequences, and transcription terminators. At a minimum, the control sequences include a promoter, and transcriptional and translational stop signals. In some embodiments, the control sequences are provided with linkers for the purpose of introducing specific restriction sites facilitating ligation of the control sequences with the coding region of the nucleic acid sequence encoding a polypeptide.

"Operably linked" or "operatively linked" refers to a configuration in which a control sequence is appropriately placed (i.e., in a functional relationship) at a position relative to a polynucleotide of interest such that the control sequence directs or regulates the expression of the polynucleotide, and in some embodiments, expression of an encoded a polypeptide of interest.

"Promoter" or "promoter sequence" refers to a nucleic acid sequence that is recognized by a host cell for expression of a polynucleotide of interest, such as a coding sequence.

The promoter sequence contains transcriptional control sequences that mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides, either homologous or heterologous to the host cell.

"Suitable reaction conditions" or "suitable conditions" refers to those conditions in the enzymatic conversion reaction solution (e.g., ranges of enzyme loading, substrate loading, temperature, pH, buffers, co-solvents, cofactors, etc.) under which a DNA ligase polypeptide of the present disclosure is capable of converting a polynucleotide(s) substrate to the desired ligated product polynucleotide. Exemplary "suitable reaction conditions" are provided herein (see, the Examples).

"Product" in the context of an enzymatic conversion process refers to the compound or molecule resulting from the action of the DNA ligase polypeptide on the substrate.

"Culturing" refers to the growing of a population of cells under suitable conditions using any suitable medium (e.g., liquid, gel, or solid).

"Vector" refers to a recombinant construct for introducing a polynucleotide of interest into a cell. In some embodiments, the vector is an expression vector that is operably linked to a suitable control sequence capable of effecting the expression in a suitable host of the polynucleotide or a polypeptide encoded in the polynucleotide. In some embodiments, an "expression vector" has a promoter sequence operably linked to the polynucleotide (e.g., transgene) to drive expression in a host cell, and in some embodiments, also comprises a transcription terminator sequence.

"Expression" includes any step involved in the production of a polypeptide of interest, including, but not limited to, transcription, post-transcriptional modification, translation, and post-translational modification.

In some embodiments, the term also encompasses secretion of the polypeptide from a cell.

"Produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

"Heterologous" or "recombinant" refers to the relationship between two or more nucleic acid or polypeptide sequences (e.g., a promoter sequence, signal peptide, terminator sequence, etc.) that are derived from different sources and are not associated in nature.

"Host cell" and "host strain" refer to suitable hosts for expression vectors comprising a polynucleotide provided herein (e.g., a polynucleotide sequences encoding at least one DNA ligase variant). In some embodiments, the host cells are prokaryotic or eukaryotic cells that have been transformed or transfected with vectors constructed using recombinant DNA techniques as known in the art.

Engineered DNA Ligase Polypeptides

In one aspect, the present disclosure provides DNA ligases, including engineered DNA ligase polypeptide variants having DNA ligase activity and characterized by having improved properties compared to the naturally occurring wild-type DNA ligase. In some embodiments, the DNA ligase and engineered DNA ligase polypeptide variants are useful for ligating polynucleotide substrates, particularly DNA substrates. In some embodiments, the engineered DNA ligase can be prepared and used as non-fusion polypeptides or as fusion polypeptides.

In some embodiments, the engineered DNA ligase, or a functional fragment thereof, comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 437 of an even-numbered SEQ ID NO. of SEQ ID NOs: 2 and 40-1184, or to a reference sequence corresponding to an even-numbered SEQ ID NO. of SEQ ID NOs: 2 and 40-1184, wherein the amino acid sequence comprises one or more substitutions relative to a reference sequence corresponding to residues 12 to 437 of SEQ ID NO: 2, 62, 138, 318, 722, or 938, or relative to a reference sequence corresponding to SEQ ID NO: 2, 62, 138, 318, 722, or 938.

In some embodiments, the engineered DNA ligase, or a functional fragment thereof, comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 2, 62, 138, 318, 722, or 938, or to the reference sequence corresponding to SEQ ID NO: 2, 62, 138, 318, 722, or 938, wherein the amino acid sequence comprises one or more substitutions relative to the reference sequence corresponding to residues 12 to 437 of SEQ ID NO: 2, 62, 138, 318, 722, or 938, or relative to the reference sequence corresponding to SEQ ID NO: 2, 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 2, or to the reference sequence corresponding to SEQ ID NO: 2, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 11, 12, 13, 14, 18, 30, 31, 33, 34, 36, 37, 44, 50, 56, 59, 60, 61, 63, 67, 68, 69, 71, 73, 74, 76, 77, 82, 88, 95, 96, 97, 99, 100, 101, 102, 103, 104, 105, 106, 110, 112, 113, 117, 125, 128, 130, 132, 138, 139, 148, 149, 150, 155, 156, 159, 161, 162, 164, 165, 177, 186, 188, 189, 190, 191, 195, 196, 197, 198, 201, 205, 207, 208, 212, 220, 226, 228, 230, 231, 232, 233, 235, 237, 239, 240, 242, 251, 254, 258, 263, 264, 266, 267, 269, 271, 273, 277, 278, 282, 283, 284, 286, 288, 289, 290, 294, 295, 297, 300, 301, 305, 306, 308, 309, 317, 323, 328, 334, 337, 339, 349, 355, 356, 357, 358, 359, 360, 362, 364, 367, 370, 372, 374, 375, 378, 379, 380, 381, 382, 384, 386, 387, 388, 389, 390, 392, 396, 397, 404, 405, 408, 414, 415, 416, 417, 418, 419, 421, 422, 423, or 428, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or an amino acid residue I1D, 12A/I, 13G/R, 14G/S/T/V, 18D/N/S, 30C/H/S, 31R, 33M/R/V, 34L/R, 36T/Y, 37G/L/N/S, 44S, 50G/I/S/T, 56P, 59E, 60Y, 61T/V, 63F/R, 67R, 68A/M/S/V/Y, 69T, 71G/L/P/R, 73C/K/P/T/V/W, 74S, 76F/G/H/L/N/R, 77D, 82R, 88V, 95A/L/R/V, 96A/G/T/V, 97G, 99G/I, 100V, 101R, 102G/K/L/S, 103V, 104K, 105K/S/T, 106L/S/V, 110R, 112M, 113A/T, 117G/S/V/Y, 125R/T, 128C, 130T, 132R, 138L/R, 139T, 148P, 149P, 150C/F/T, 155R, 156C, 159Q, 161R/V, 162W, 164A/R, 165K, 177G, 186A/C/E/H/L/M/R/T/V, 188A, 189C/T, 190R, 191T, 195R, 196E/V, 197R, 198A/D/K/L/N/R/V/W, 201L/S, 205E/G/K, 207L, 208D/F/H, 212F/G/M/S/W, 220V, 226D/E/Q/S/V, 228E/I/M/S, 230L/M, 231P, 232R, 233G/T/W, 235W, 237L/M/R/S/V/Y, 239M/N/P/Q/S/T/V/W, 240E/G/K/Q/R/S/Y, 242P/Q/T, 251L, 254G/S, 258L/S/V, 263G/L/Q/T, 264A/C, 266M/T, 267D/W/Y, 269L, 271A/G/N/S, 273A/G/S, 277Q/R, 278E, 282G/L/M/T/V/Y, 283A/G/K/L/M/R/S/V, 284D, 286F/L/S, 288L, 289A/L/S/V, 290L, 294L, 295K, 297W, 300G/T, 301F/L, 305K, 306I/K/SN, 308K/L/S, 309G/R, 317Q, 323S, 328R, 334L/R, 337G/L/M/P/R/S, 339Y, 349E, 355S, 356A/V/W, 357H/K/P/R/S/V, 358C, 359N/R, 360H/M/P, 362G, 363R, 364R, 367C/L, 370C/G, 372N/Q, 374A/S, 375W, 378T, 379A/G/P, 380T, 381K/R, 382V, 384C/V, 386F, 387G, 388K/Y, 389K/L/Q/R, 390E, 392C/I/K/L/R/S, 396C/H, 397K/L/M, 404S, 405I, 408C/V, 414A/L/Q/R/T/V, 415A/C/E/H/I/K/L/V, 416K, 417D/G/L, 418A/G/I/L/M/P/S/T, 419G, 421R, 422N, 423R/T, or 428F/R/S, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution G11D, M12A/I, T13G/R, K14G/S/T/V, Q18D/N/S, T30C/H/S, S31R, T33M/R/V, A34L/R, E36T/Y, D37G/L/N/S, D44S, E50G/I/S/T, Y56P, D59E, L60Y, I61T/V, G63F/R, K67R, I68A/M/S/V/Y, K69T, K71G/L/P/R, L73C/K/P/T/V/W, P74S, D76F/G/H/L/N/R, Y77D, D82R, L88V, Y95A/L/R/V, N96A/G/T/V, R97G, L99G/I, T100V, G101R, N102G/K/L/S, A103V, A104K, L105K/S/T, D106L/S/V, V110R, L112M, S113A/T, Q117G/S/V/Y, K125R/T, Q128C, D130T, K132R, K138L/R, S139T, I148P, A149P, E150C/F/T, L155R, A156C, L159Q, K161R/V, Y162W, K164A/R, R165K, C177G, K186A/C/E/H/L/M/R/T/V, V188A, L189C/T, K190R, S191T, K195R, I196E/V, I197R, T198A/D/K/L/N/R/V/W, T201L/S, Q205E/G/K, I207L, A208D/F/H, V212F/G/M/S/W, I220V, K226D/E/Q/S/V, A228E/I/M/S, V230L/M, Q231P, K232R, S233G/T/W, F235W, K237L/M/R/S/V/Y, D239M/N/P/Q/S/T/V/W, D240E/G/K/Q/R/S/Y, V242P/Q/T, V251L, H254G/S, A258L/S/V, R263G/L/Q/T, I264A/C, E266M/T, Q267D/W/Y, I269L, F271A/G/N/S, R273A/G/S, E277Q/R, Q278E, E282G/L/M/T/V/Y, F283A/G/K/L/M/R/S/V, P284D, W286F/L/S, L288I, E289A/L/S/V, W290L, D294L, G295K, F297W, S300G/T, E301F/L, Q305K, E306I/K/S/V, F308K/L/S, H309G/R, T317Q, M323S, D328R, K334L/R, F337G/L/M/P/R/S, I339Y, D349E, F355S, E356A/V/W, E357H/K/P/R/S/V, G358C, K359N/R, E360H/M/P, T362G, K363R, N364R, V367C/L, A370C/G, V372N/Q, E374A/S, Y375W, N378T, E379A/G/P, V380T, S381K/R, I382V, G384C/V, Y386F, T387G, D388K/Y, E389K/L/Q/R, M390E, V392C/I/K/L/R/S, A396C/H, R397K/L/M, K404S, V405I, I408C/V, S414A/L/Q/R/T/V, T415A/C/E/H/I/K/L/V, S416K, S417D/G/L, K418A/G/I/L/M/P/S/T, T419G, K421R, K422N, S423R/T, or E428F/R/S, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 63, 242, 283, 286, 317, 414, 418, or 428, or combinations thereof, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution 63F/R, 242P/Q/T, 283A/G/K/L/M/R/S/V, 286F/L/S, 317Q, 414A/L/Q/R/T/V, 418A/G/I/L/M/P/S/T, or 428F/R/S, or combinations thereof, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution 63R, 242Q, 283L, 286S, 317Q, 414Q, 418S, or 428R, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 428, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution 428R, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution E428R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 317, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution 317Q, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution T317Q, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 283, 286, or 418, or combinations thereof, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution 283L, 286S, or 418S, or combinations thereof, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution F283L, W286S, or K418S, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 242 or 414, or combinations thereof, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution 242Q or 414Q, or combination thereof, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution V242Q or S414Q, or combination thereof, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at amino acid position 63, wherein the amino acid positions are relative to the reference sequence corresponding to residues 12 to 437 of SEQ ID NO: 2, or relative to the reference sequence corresponding to SEQ ID NO: 2. In some embodiments, the amino acid sequence of the engineered DNA ligase comprises at least a substitution 63R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution G63R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) 233, 317, 191, 288, 207, 149, 251, 205, 269, 164, 36, 428, 105/132, or 105, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set 233T, 317Q, 191T, 288I, 207L, 149P, 251L, 205E, 269L, 164A, 36T, 428R, 105K/132R, or 105K, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set S233T, T317Q, S191T, L288I, I207L, A149P, V251L, Q205E, I269L, K164A, E36T, E428R, L105K/K132R, or L105K, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) 196/428, 242/428, 337/428, 33/428, 277/428, 30/428, 359/428, 283/428, 415/428, 387/428, 379/428, 205/428, 186/428, 389/428, 102/428, 164/428, 301/428, 375/428, 267/428, 380/428, 254/428, 317/428, 77/139/317/417/428, 105/317/417/428, 317/349/362/386/428, 105/317/428, 139/317/362/428, 233/317/405/428, 139/317/428, 162/428, 286/428, 414/428, 417/428, 226/428, 61/428, 105/428, 230/428, 418/428, 370/428, 297/428, 237/428, 428, 362/428, 233/428, 235/428, 148/428, 100/428, 97/428, 382/428, or 358/428, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set 196E/428R, 242P/428R, 337L/428R, 33R/428R, 33V/428R, 277Q/428R, 337P/428R, 30C/428R, 359N/428R, 337G/428R, 283S/428R, 242Q/428R, 415A/428R, 387G/428R, 415H/428R, 379A/428R, 205G/428R, 186M/428R, 337M/428R, 389Q/428R, 102L/428R, 389L/428R, 359R/428R, 205K/428R, 164A/428R, 415E/428R, 301F/428R, 30H/428R, 379G/428R, 375W/428R, 267W/428R, 380T/428R, 415C/428R, 254G/428R, 186T/428R, 317Q/428R, 77D/139T/317Q/417G/428R, 105K/317Q/417G/428R, 317Q/349E/362G/386F/428R, 105K/317Q/428R, 139T/317Q/362G/428R, 233T/317Q/405I/428R, 139T/317Q/428R, 162W/428R, 283V/428R, 286L/428R, 414L/428R, 417L/428R, 226S/428R, 61T/428R, 226Q/428R, 105S/428R, 186E/428R, 230M/428R, 61V/428R, 186V/428R, 186L/428R, 379P/428R, 415V/428R, 415I/428R, 186A/428R, 283R/428R, 226V/428R, 418L/428R, 418S/428R, 370G/428R, 283A/428R, 337S/428R, 297W/428R, 237S/428R, 428S, 186C/428R, 362G/428R, 283G/428R, 196V/428R, 237L/428R, 415L/428R, 233W/428R, 242T/428R, 277R/428R, 235W/428R, 148P/428R, 254S/428R, 102G/428R, 105T/428R, 301L/428R, 286F/428R, 100V/428R, 237Y/428R, 30S/428R, 428F, 414Q/428R, 414V/428R, 283L/428R, 414A/428R, 414R/428R, 370C/428R, 283K/428R, 286L/428R, 186H/428R, 417D/428R, 226D/428R, 233G/428R, 267Y/428R, 97G/428R, 226E/428R, 418T/428R, 230L/428R, 414T/428R, 418A/428R, 237V/428R, 418G/428R, 382V/428R, 267D/428R, 283M/428R, 418P/428R, 237R/428R, 237M/428R, 418I/428R, 358C/428R, 186R/428R, 418M/428R, or 102S/428R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set of an engineered DNA ligase variant set forth in Table 11.2 and 12.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) 242/283/286/317/359/418/428, 283/286/317/428, 283/286/317/418/428, 186/242/283/286/317/418/428, 205/286/317/359/428, 283/317/428, 242/286/317/418/428, 186/205/242/317/428, 283/286/317/359/428, 277/286/317/359/418/428, 186/205/283/286/317/359/428, 242/277/317/418/428, 242/283/286/317/418/428, 112/196/317/389/428, 286/317/428, 283/286/317/359/418/428, 242/317/359/418/428, 186/283/317/428, 186/317/359/418/428, 205/242/317/418/428, 186/205/242/283/286/317/359/418/428, 205/317/359/418/428, 186/205/283/286/317/418/428, 186/283/317/359/428, 186/242/317/428, 186/242/317/359/428, 283/317/359/418/428, 277/317/418/428, 186/188/283/317/428, 186/286/317/418/428, 186/242/286/317/359/418/428, 317/418/428, 186/242/283/286/317/359/418/428, 186/277/317/359/418/428, 242/283/286/317/428, 205/317/418/428, 30/297/317/428, 205/242/286/317/359/418/428, 186/205/317/359/418/428, 317/359/418/428, 186/317/428, 230/317/428, 33/297/317/428, 186/205/317/428, 186/283/317/359/418/428, 186/317/418/428, 205/242/283/317/359/418/428, 33/317/375/389/428, 33/230/317/428, 196/242/283/286/317/359/418/428, 186/242/283/317/359/418/428, 186/317/359/428, 33/196/317/428, 186/277/317/418/428, 242/317/428, 33/196/297/301/317/428, 205/237/242/283/286/317/359/428, 186/205/283/317/359/418/428, 33/317/389/428, or 186/196/242/283/286/317/359/418/428, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set 242Q/283V/286S/317Q/359R/418L/428R, 283L/286S/317Q/428R, 283L/286S/317Q/418S/428R, 186E/242Q/283V/286S/317Q/418L/428R, 205K/286S/317Q/359R/428R, 283V/317Q/428R, 242P/286S/317Q/418T/428R, 186E/205K/242T/317Q/428R, 283L/286S/317Q/359R/428R, 277Q/286S/317Q/359N/418T/428R, 186A/205K/283V/286S/317Q/359R/428R, 242Q/277Q/317Q/418L/428R, 242Q/283S/286S/317Q/418T/428R, 112M/196V/317Q/389Q/428R, 286S/317Q/428R, 242P/283R/286S/317Q/359R/418L/428R, 283L/286S/317Q/359R/418S/428R, 242Q/317Q/359N/418S/428R, 186E/283L/317Q/428R, 186E/317Q/359R/418S/428R, 205K/242T/317Q/418S/428R, 186E/205K/242Q/283S/286S/317Q/359R/418S/428R, 205K/317Q/359N/418L/428R, 186A/205K/283L/286S/317Q/418L/428R, 242T/283V/286S/317Q/359R/418S/428R, 186E/283L/317Q/359R/428R, 186E/242P/317Q/428R, 283V/286S/317Q/418S/428R, 186E/242T/317Q/359R/428R, 283L/317Q/359R/418L/428R, 277Q/317Q/418S/428R, 186E/188A/283V/317Q/428R, 186E/286S/317Q/418S/428R, 186A/242T/286S/317Q/359N/418L/428R, 317Q/418L/428R, 186A/242P/283V/286S/317Q/359R/418S/428R, 186A/277Q/317Q/359R/418S/428R, 242Q/283R/286S/317Q/428R, 205K/317Q/418S/428R, 30C/297W/317Q/428R, 283L/317Q/359R/418S/428R, 186E/286S/317Q/418L/428R, 317Q/418T/428R, 205K/242T/286S/317Q/359R/418S/428R, 186E/205K/317Q/359N/418T/428R, 317Q/418S/428R, 186E/242T/283S/286S/317Q/418S/428R, 317Q/359R/418S/428R, 242T/286S/317Q/418S/428R, 186E/317Q/428R, 230L/317Q/428R, 33V/297W/317Q/428R, 186E/205K/317Q/428R, 186A/283L/317Q/359R/418S/428R, 186E/317Q/418L/428R, 186E/277Q/317Q/359R/418S/428R, 205K/242T/283R/317Q/359R/418L/428R, 186E/317Q/418T/428R, 33V/317Q/375W/389Q/428R, 33R/230L/317Q/428R, 196E/242T/283V/286S/317Q/359R/418T/428R, 186E/242T/283L/317Q/359R/418S/428R, 186E/317Q/359R/428R, 33V/196V/317Q/428R, 33R/317Q/375W/389Q/428R, 186A/277Q/317Q/418S/428R, 186A/242T/283L/286S/317Q/418L/428R, 242T/317Q/428R, 33V/196V/297W/301F/317Q/428R, 205K/237Y/242P/283L/286S/317Q/359R/428R, 186A/205K/283L/317Q/359R/418T/428R, 33V/317Q/389Q/428R, or 186A/196E/242T/283L/286S/317Q/359N/418T/428R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set of an engineered DNA ligase variant set forth in Table 13.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) 283/286/317/363/418/428, 63/283/286/317/418/428, 283/286/317/389/418/428, 283/286/317/381/418/428, 197/283/286/317/418/428, 283/286/317/359/418/428, 102/283/286/317/418/428, 165/283/286/317/418/428, 283/286/317/388/418/428, 283/286/317/414/418/428, 283/286/317/337/418/428, 164/283/286/317/418/428, 283/286/317/416/418/428, 101/283/286/317/418/428, 283/286/317/415/418/428, 283/286/317/418/423/428, 283/286/317/364/418/428, 73/283/286/317/418/428, 50/283/286/317/418/428, 71/283/286/317/418/428, 283/286/317/388/418/419/428, 283/286/317/357/418/428, 283/286/317/396/418/428, 68/283/286/317/418/428, 76/283/286/317/418/428, 14/283/286/317/418/428, 271/283/286/317/418/428, 283/286/317/360/418/428, 266/283/286/317/418/428, 208/283/286/317/418/428, 74/283/286/317/418/428, 263/283/286/317/418/428, 264/283/286/317/418/428, 13/283/286/317/418/428, 283/286/317/378/418/428, 283/286/317/372/418/428, 283/286/300/317/418/428, 283/286/294/317/418/428, 283/286/290/317/418/428, 283/286/317/397/418/428, 95/283/286/317/418/428, 258/283/286/317/418/428, 161/283/286/317/418/428, 212/283/286/317/418/428, 198/283/286/317/418/428, 138/283/286/317/418/428, 18/283/286/317/418/428, 283/286/317/404/418/428, 273/283/286/317/418/428, 117/283/286/317/418/428, 240/283/286/317/418/428, 69/283/286/317/418/428, 278/283/286/317/418/428, 283/286/289/317/418/428, 82/283/286/317/418/428, 283/286/317/328/418/428, 61/186/283/286/317/417/418/428, 186/283/286/317/370/417/418/428, 267/283/286/317/418/428, 61/283/286/317/370/418/428, 186/267/283/286/317/370/417/418/428, 61/186/283/286/317/418/428, 283/286/317/370/417/418/428, 283/286/317/417/418/

428, 61/283/286/317/370/382/418/428, 61/186/267/283/286/317/370/417/418/428, 61/283/286/317/418/428, 267/283/286/317/370/417/418/428, 267/283/286/317/370/418/428, 61/283/286/317/417/418/428, 61/186/237/267/283/286/317/370/418/428, 61/237/283/286/317/370/417/418/428, 283/286/317/370/418/428, 186/283/286/317/370/418/428, 61/186/267/283/286/317/417/418/428, 61/186/283/286/317/370/382/418/428, 283/286/317/370/382/417/418/428, 61/186/283/286/317/370/418/428, 237/267/283/286/317/370/417/418/428, 61/186/283/286/317/382/418/428, 61/267/283/286/317/418/428, 61/267/283/286/317/417/418/428, 61/237/267/283/286/317/382/418/428, 186/283/286/317/370/382/418/428, 237/267/283/286/317/370/418/428, 61/186/267/283/286/317/370/418/428, 186/237/267/283/286/317/370/418/428, 61/186/267/283/286/317/418/428, 61/186/237/283/286/317/418/428, 186/283/286/317/418/428, 186/267/283/286/317/418/428, 237/283/286/317/370/417/418/428, 242/283/286/317/414/418/428, 162/283/286/317/414/418/428, 267/283/286/317/414/418/428, 105/283/286/317/414/418/428, 162/242/283/286/317/414/418/428, 97/162/283/286/317/414/418/428, 105/162/267/283/286/317/414/418/428, 283/286/317/356/418/428, 283/286/317/392/418/428, 106/283/286/317/418/428, 283/286/308/317/418/428, 283/286/306/317/418/428, 96/283/286/317/418/428, 282/283/286/317/418/428, 113/283/286/317/418/428, 283/286/309/317/418/428, 110/283/286/317/418/428, 37/283/286/317/418/428, 201/283/286/317/418/428, 283/284/286/317/418/428, 283/286/317/374/418/428, 283/286/295/317/418/428, 88/283/286/317/418/428, 44/283/286/317/418/428, 12/283/286/317/418/428, or 283/286/317/390/418/428, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set 283L/286S/317Q/363R/418S/428R, 63R/283L/286S/317Q/418S/428R, 283L/286S/317Q/389K/418S/428R, 283L/286S/317Q/381R/418S/428R, 283L/286S/317Q/389R/418S/428R, 197R/283L/286S/317Q/418S/428R, 283L/286S/317Q/359R/418S/428R, 283L/286S/317Q/381K/418S/428R, 102K/283L/286S/317Q/418S/428R, 165K/283L/286S/317Q/418S/428R, 283L/286S/317Q/388K/418S/428R, 283L/286S/317Q/414R/418S/428R, 283L/286S/317Q/337R/418S/428R, 164R/283L/286S/317Q/418S/428R, 283L/286S/317Q/416K/418S/428R, 101R/283L/286S/317Q/418S/428R, 283L/286S/317Q/415K/418S/428R, 283L/286S/317Q/418S/423R/428R, 283L/286S/317Q/364R/418S/428R, 73P/283L/286S/317Q/418S/428R, 50I/283L/286S/317Q/418S/428R, 71L/283L/286S/317Q/418S/428R, 283L/286S/317Q/388Y/418S/419G/428R, 50G/283L/286S/317Q/418S/428R, 283L/286S/317Q/357K/418S/428R, 283L/286S/317Q/396H/418S/428R, 68Y/283L/286S/317Q/418S/428R, 76F/283L/286S/317Q/418S/428R, 71P/283L/286S/317Q/418S/428R, 14V/283L/286S/317Q/418S/428R, 271G/283L/286S/317Q/418S/428R, 68A/283L/286S/317Q/418S/428R, 68M/283L/286S/317Q/418S/428R, 283L/286S/317Q/360P/418S/428R, 266M/283L/286S/317Q/418S/428R, 208D/283L/286S/317Q/418S/428R, 74S/283L/286S/317Q/418S/428R, 263T/283L/286S/317Q/418S/428R, 264C/283L/286S/317Q/418S/428R, 13R/283L/286S/317Q/418S/428R, 263L/283L/286S/317Q/418S/428R, 283L/286S/317Q/360M/418S/428R, 283L/286S/317Q/378T/418S/428R, 76H/283L/286S/317Q/418S/428R, 13G/283L/286S/317Q/418S/428R, 76R/283L/286S/317Q/418S/428R, 50T/283L/286S/317Q/418S/428R, 283L/286S/317Q/372Q/418S/428R, 50S/283L/286S/317Q/418S/428R, 283L/286S/S300G/317Q/418S/428R, 73T/283L/286S/317Q/418S/428R, 283L/286S/294L/317Q/418S/428R, 283L/286S/317Q/372N/418S/428R, 76N/283L/286S/317Q/418S/428R, 283L/286S/290L/317Q/418S/428R, 283L/286S/317Q/397L/418S/428R, 76G/283L/286S/317Q/418S/428R, 95L/283L/286S/317Q/418S/428R, 258L/283L/286S/317Q/418S/428R, 161V/283L/286S/317Q/418S/428R, 212M/283L/286S/317Q/418S/428R, 198V/283L/286S/317Q/418S/428R, 138L/283L/286S/317Q/418S/428R, 18D/283L/286S/317Q/418S/428R, 18S/283L/286S/317Q/418S/428R, 283L/286S/317Q/404S/418S/428R, 273G/283L/286S/317Q/418S/428R, 117G/283L/286S/317Q/418S/428R, 240E/283L/286S/317Q/418S/428R, 68S/283L/286S/317Q/418S/428R, 73C/283L/286S/317Q/418S/428R, 69T/283L/286S/317Q/418S/428R, 278E/283L/286S/317Q/418S/428R, 283L/286S/317Q/360H/418S/428R, 198D/283L/286S/317Q/418S/428R, 283L/286S/300T/317Q/418S/428R, 161R/283L/286S/317Q/418S/428R, 73K/283L/286S/317Q/418S/428R, 283L/286S/289V/317Q/418S/428R, 82R/283L/286S/317Q/418S/428R, 283L/286S/317Q/328R/418S/428R, 61T/186A/283L/286S/317Q/417D/418S/428R, 186A/283L/286S/317Q/370C/417L/418S/428R, 267Y/283L/286S/317Q/418S/428R, 61T/283L/286S/317Q/370C/418S/428R, 186A/267Y/283L/286S/317Q/370C/417L/418S/428R, 61T/186C/283L/286S/317Q/418S/428R, 283L/286S/317Q/370C/417D/418S/428R, 283L/286S/317Q/417D/418S/428R, 61T/283L/286S/317Q/370C/382V/418S/428R, 61T/186A/267Y/283L/286S/317Q/370C/417D/418S/428R, 61T/283L/286S/317Q/418S/428R, 267Y/283L/286S/317Q/370C/417D/418S/428R, 267Y/283L/286S/317Q/370C/418S/428R, 61T/283L/286S/317Q/417L/418S/428R, 61T/186H/237R/267Y/283L/286S/317Q/370C/418S/428R, 61T/237R/283L/286S/317Q/370C/417L/418S/428R, 283L/286S/317Q/370C/417L/418S/428R, 283L/286S/317Q/370C/418S/428R, 186E/283L/286S/317Q/370C/418S/428R, 61T/186E/267Y/283L/286S/317Q/417D/418S/428R, 61T/186C/283L/286S/317Q/370C/382V/418S/428R, 283L/286S/317Q/370C/382V/417D/418S/428R, 61T/186C/267Y/283L/286S/317Q/417D/418S/428R, 61T/186C/283L/286S/317Q/370C/418S/428R, 237R/267Y/283L/286S/317Q/370C/417D/418S/428R, 61T/186E/283L/286S/317Q/417D/418S/428R, 61T/186H/283L/286S/317Q/418S/428R, 61T/186C/283L/286S/317Q/382V/418S/428R, 61T/186H/283L/286S/317Q/370C/418S/428R, 61T/267Y/283L/286S/317Q/418S/428R, 61T/267Y/283L/286S/317Q/417L/418S/428R, 61T/237R/267Y/283L/286S/317Q/382V/418S/428R, 186H/283L/286S/317Q/370C/382V/418S/428R, 237R/267Y/283L/286S/317Q/370C/418S/428R, 186H/283L/286S/317Q/370C/417D/418S/428R, 61T/186V/267Y/283L/286S/317Q/370C/418S/428R, 267Y/283L/286S/317Q/370C/417L/418S/428R, 61T/186V/283L/286S/317Q/370C/418S/428R, 186H/237R/267Y/283L/286S/317Q/370C/418S/428R, 61T/186E/267Y/283L/286S/317Q/418S/428R, 61T/186C/237R/283L/286S/317Q/418S/428R, 61T/186H/237R/283L/286S/317Q/418S/428R, 61T/186C/283L/286S/317Q/417L/418S/428R, 186H/283L/286S/317Q/418S/428R, 186A/267Y/283L/286S/317Q/418S/428R, 186C/283L/286S/317Q/370C/418S/428R, 61T/186C/237R/267Y/283L/286S/317Q/370C/418S/428R, 186E/267Y/283L/286S/317Q/418S/428R, 237R/283L/286S/317Q/370C/417L/418S/428R, 186H/283L/286S/317Q/370C/418S/428R, 242Q/283L/286S/317Q/414Q/418S/428R, 283L/286S/317Q/414T/418S/428R, 283L/286S/317Q/414Q/418S/428R, 162W/283L/286S/317Q/414Q/418S/428R, 162W/283L/286S/317Q/414V/418S/428R, 267D/283L/286S/317Q/414T/418S/428R, 283L/286S/317Q/

414V/418S/428R, 267D/283L/286S/317Q/414Q/418S/428R, 283L/286S/317Q/414A/418S/428R, 162W/283L/286S/317Q/414L/418S/428R, 105S/283L/286S/317Q/414T/418S/428R, 162W/242Q/283L/286S/317Q/414T/418S/428R, 97G/162W/283L/286S/317Q/414Q/418S/428R, 105S/162W/267D/283L/286S/317Q/414V/418S/428R, 283L/286S/317Q/356V/418S/428R, 273A/283L/286S/317Q/418S/428R, 283L/286S/317Q/357P/418S/428R, 14G/283L/286S/317Q/418S/428R, 14S/283L/286S/317Q/418S/428R, 283L/286S/317Q/396C/418S/428R, 240R/283L/286S/317Q/418S/428R, 283L/286S/317Q/392K/418S/428R, 273S/283L/286S/317Q/418S/428R, 106V/283L/286S/317Q/418S/428R, 283L/286S/308S/317Q/418S/428R, 283L/286S/308L/317Q/418S/428R, 283L/286S/306I/317Q/418S/428R, 96A/283L/286S/317Q/418S/428R, 283L/286S/317Q/397K/418S/428R, 263Q/283L/286S/317Q/418S/428R, 282T/283L/286S/317Q/418S/428R, 138R/283L/286S/317Q/418S/428R, 258S/283L/286S/317Q/418S/428R, 76L/283L/286S/317Q/418S/428R, 14T/283L/286S/317Q/418S/428R, 283L/286S/289S/317Q/418S/428R, 240G/283L/286S/317Q/418S/428R, 106S/283L/286S/317Q/418S/428R, 117S/283L/286S/317Q/418S/428R, 283L/286S/317Q/357S/418S/428R, 96G/283L/286S/317Q/418S/428R, 113T/283L/286S/317Q/418S/428R, 71G/283L/286S/317Q/418S/428R, 282V/283L/286S/317Q/418S/428R, 117V/283L/286S/317Q/418S/428R, 282M/283L/286S/317Q/418S/428R, 258V/283L/286S/317Q/418S/428R, 283L/286S/309G/317Q/418S/428R, 283L/286S/306K/317Q/418S/428R, 283L/286S/308K/317Q/418S/428R, 283L/286S/317Q/357R/418S/428R, 212S/283L/286S/317Q/418S/428R, 18N/283L/286S/317Q/418S/428R, 113A/283L/286S/317Q/418S/428R, 283L/286S/306S/317Q/418S/428R, 212F/283L/286S/317Q/418S/428R, 198N/283L/286S/317Q/418S/428R, 110R/283L/286S/317Q/418S/428R, 240K/283L/286S/317Q/418S/428R, 198L/283L/286S/317Q/418S/428R, 71R/283L/286S/317Q/418S/428R, 283L/286S/317Q/357V/418S/428R, 198R/283L/286S/317Q/418S/428R, 271A/283L/286S/317Q/418S/428R, 282Y/283L/286S/317Q/418S/428R, 212G/283L/286S/317Q/418S/428R, 95V/283L/286S/317Q/418S/428R, 37S/283L/286S/317Q/418S/428R, 68V/283L/286S/317Q/418S/428R, 240S/283L/286S/317Q/418S/428R, 117Y/283L/286S/317Q/418S/428R, 201S/283L/286S/317Q/418S/428R, 271N/283L/286S/317Q/418S/428R, 240Q/283L/286S/317Q/418S/428R, 283L/286S/289L/317Q/418S/428R, 212W/283L/286S/317Q/418S/428R, 198W/283L/286S/317Q/418S/428R, 283L/286S/317Q/357H/418S/428R, 208F/283L/286S/317Q/418S/428R, 282L/283L/286S/317Q/418S/428R, 283L/286S/306V/317Q/418S/428R, 283L/284D/286S/317Q/418S/428R, 96T/283L/286S/317Q/418S/428R, 266T/283L/286S/317Q/418S/428R, 283L/286S/317Q/374S/418S/428R, 95R/283L/286S/317Q/418S/428R, 283L/286S/309R/317Q/418S/428R, 73W/283L/286S/317Q/418S/428R, 283L/286S/317Q/R397M/418S/428R, 283L/286S/289A/317Q/418S/428R, 283L/286S/295K/317Q/418S/428R, 106L/283L/286S/317Q/418S/428R, 95A/283L/286S/317Q/418S/428R, 283L/286S/317Q/374A/418S/428R, 88V/283L/286S/317Q/418S/428R, 96V/283L/286S/317Q/418S/428R, 271S/283L/286S/317Q/418S/428R, 44S/283L/286S/317Q/418S/428R, 208H/283L/286S/317Q/418S/428R, 263G/283L/286S/317Q/418S/428R, 12A/283L/286S/317Q/418S/428R, 201L/283L/286S/317Q/418S/428R, 198A/283L/286S/317Q/418S/428R, 198K/283L/286S/317Q/418S/428R, 282G/283L/286S/317Q/418S/428R, 283L/286S/317Q/390E/418S/428R, 264A/283L/286S/317Q/418S/428R, or 73V/283L/286S/317Q/418S/428R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set forth in Tables 14.2, 15.2, and 16.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) 63/242/283/286/317/414/418/428, 63/96/242/283/286/317/370/414/418/428, 242/283/286/317/389/414/418/428, 13/242/267/283/286/317/363/389/414/418/428, 13/186/242/283/286/317/389/414/418/428, 50/242/267/283/286/317/363/370/389/414/418/428, 242/283/286/317/363/370/414/418/428, 96/242/283/286/317/370/414/418/428, 61/63/212/242/283/286/317/414/418/428, 11/242/283/286/305/317/414/418/428, 11/242/283/286/317/414/418/428, 428, 242/283/286/317/323/414/418/428, 242/283/286/317/334/414/418/428, 242/283/286/317/339/414/418/428, 242/283/286/317/356/414/418/428, 242/283/286/317/384/414/418/428, 242/283/286/317/408/414/418/428, 67/242/283/286/317/414/418/428, 242/283/286/317/392/414/418/428, 104/242/283/286/317/414/418/428, 242/283/286/317/355/414/418/428, 159/242/283/286/317/414/418/428, 155/242/283/286/317/414/418/428, 242/283/286/317/367/414/418/428, 31/242/283/286/317/414/418/428, 231/242/283/286/317/414/418/428, 36/242/283/286/317/414/418/428, 150/242/283/286/317/414/418/428, 239/242/283/286/317/414/418/428, 103/242/283/286/317/414/418/428, 125/242/283/286/317/414/418/428, 228/242/283/286/317/414/418/428, 37/242/283/286/317/414/418/428, 189/242/283/286/317/414/418/428, 177/242/283/286/317/414/418/428, 242/283/286/317/414/418/422/428, 128/242/283/286/317/414/418/428, 220/242/283/286/317/414/418/428, 130/242/283/286/317/414/418/428, 56/242/283/286/317/414/418/428, 190/242/283/286/317/414/418/428, 156/242/283/286/317/414/418/428, 232/242/283/286/317/414/418/428, 242/283/286/317/414/418/423/428, 34/242/283/286/317/414/418/428, 99/242/283/286/317/414/418/428, 59/242/283/286/317/414/418/428, 60/242/283/286/317/414/418/428, 242/283/286/317/414/418/421/428, or 195/242/283/286/317/414/418/428, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set 63R/242Q/283L/286S/317Q/414Q/418S/428R, 63R/96T/242Q/283L/286S/317Q/370C/414Q/418S/428R, 242Q/283L/286S/317Q/389K/414Q/418S/428R, 13R/242Q/267Y/283L/286S/317Q/363R/389K/414Q/418S/428R, 13R/186H/242Q/283L/286S/317Q/389K/414Q/418S/428R, 50T/242Q/267Y/283L/286S/317Q/363R/370C/389K/414Q/418S/428R, 242Q/283L/286S/317Q/363R/370C/414Q/418S/428R, 96T/242Q/283L/286S/317Q/370C/414Q/418S/428R, 61T/63R/212W/242Q/283L/286S/317Q/414Q/418S/428R, 11D/242Q/283L/286S/Q305K/317Q/414Q/418S/428R, 11D/242Q/283L/286S/317Q/414Q/418S/428R, 428R, 242Q/283L/286S/317Q/323S/414Q/418S/428R, 242Q/283L/286S/317Q/334L/414Q/418S/428R, 242Q/283L/286S/317Q/339Y/414Q/418S/428R, 242Q/283L/286S/317Q/356V/414Q/418S/428R, 242Q/283L/

286S/317Q/384V/414Q/418S/428R, 242Q/283L/286S/317Q/408C/414Q/418S/428R, 67R/242Q/283L/286S/317Q/414Q/418S/428R, 242Q/283L/286S/317Q/392R/414Q/418S/428R, 104K/242Q/283L/286S/317Q/414Q/418S/428R, 242Q/283L/286S/317Q/355S/414Q/418S/428R, 159Q/242Q/283L/286S/317Q/414Q/418S/428R, 155R/242Q/283L/286S/317Q/414Q/418S/428R, 242Q/283L/286S/317Q/367L/414Q/418S/428R, 31R/242Q/283L/286S/317Q/414Q/418S/428R, 231P/242Q/283L/286S/317Q/414Q/418S/428R, 36Y/242Q/283L/286S/317Q/414Q/418S/428R, 150T/242Q/283L/286S/317Q/414Q/418S/428R, 239V/242Q/283L/286S/317Q/414Q/418S/428R, 103V/242Q/283L/286S/317Q/414Q/418S/428R, 242Q/283L/286S/317Q/356A/414Q/418S/428R, 63F/242Q/283L/286S/317Q/414Q/418S/428R, 125T/242Q/283L/286S/317Q/414Q/418S/428R, 242Q/283L/286S/317Q/367C/414Q/418S/428R, 228I/242Q/283L/286S/317Q/414Q/418S/428R, 37S/242Q/283L/286S/317Q/414Q/418S/428R, 37G/242Q/283L/286S/317Q/414Q/418S/428R, 239M/242Q/283L/286S/317Q/414Q/418S/428R, 239W/242Q/283L/286S/317Q/414Q/418S/428R, 239Q/242Q/283L/286S/317Q/414Q/418S/428R, 189C/242Q/283L/286S/317Q/414Q/418S/428R, 239S/242Q/283L/286S/317Q/414Q/418S/428R, 239T/242Q/283L/286S/317Q/414Q/418S/428R, 177G/242Q/283L/286S/317Q/414Q/418S/428R, 239P/242Q/283L/286S/317Q/414Q/418S/428R, 37N/242Q/283L/286S/317Q/414Q/418S/428R, 242Q/283L/286S/317Q/414Q/418S/422N/428R, 228S/242Q/283L/286S/317Q/414Q/418S/428R, 125R/242Q/283L/286S/317Q/414Q/418S/428R, 128C/242Q/283L/286S/317Q/414Q/418S/428R, 189T/242Q/283L/286S/317Q/414Q/418S/428R, 242Q/283L/286S/317Q/356W/414Q/418S/428R, 220V/242Q/283L/286S/317Q/414Q/418S/428R, 242Q/283L/286S/317Q/408V/414Q/418S/428R, 242Q/283L/286S/317Q/392S/414Q/418S/428R, 130T/242Q/283L/286S/317Q/414Q/418S/428R, 228M/242Q/283L/286S/317Q/414Q/418S/428R, 56P/242Q/283L/286S/317Q/414Q/418S/428R, 228E/242Q/283L/286S/317Q/414Q/418S/428R, 190R/242Q/283L/286S/317Q/414Q/418S/428R, 242Q/283L/286S/317Q/392I/414Q/418S/428R, 156C/242Q/283L/286S/317Q/414Q/418S/428R, 232R/242Q/283L/286S/317Q/414Q/418S/428R, 150F/242Q/283L/286S/317Q/414Q/418S/428R, 150C/242Q/283L/286S/317Q/414Q/418S/428R, 239N/242Q/283L/286S/317Q/414Q/418S/428R, 242Q/283L/286S/317Q/392L/414Q/418S/428R, 242Q/283L/286S/317Q/414Q/418S/423T/428R, 34L/242Q/283L/286S/317Q/414Q/418S/428R, 99I/242Q/283L/286S/317Q/414Q/418S/428R, 242Q/283L/286S/317Q/384C/414Q/418S/428R, 59E/242Q/283L/286S/317Q/414Q/418S/428R, 242Q/283L/286S/317Q/334R/414Q/418S/428R, 60Y/242Q/283L/286S/317Q/414Q/418S/428R, 99G/242Q/283L/286S/317Q/414Q/418S/428R, 34R/242Q/283L/286S/317Q/414Q/418S/428R, 37L/242Q/283L/286S/317Q/414Q/418S/428R, 242Q/283L/286S/317Q/392C/414Q/418S/428R, 242Q/283L/286S/317Q/414Q/418S/421R/428R, or 195R/242Q/283L/286S/317Q/414Q/418S/428R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set of an engineered DNA ligase variant set forth in Table 17.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) 63/242/283/286/308/317/357/390/414/418/428, 63/74/76/201/242/283/286/308/317/357/414/418/428, 61/63/74/76/186/201/242/283/286/308/309/317/357/390/414/418/428, 14/63/201/240/242/283/286/289/317/357/414/418/428, 63/242/283/286/308/317/414/415/418/428, 63/76/242/283/286/317/357/396/414/418/428, 63/242/263/283/286/308/317/396/414/418/428, 61/63/76/96/240/242/283/286/308/309/317/414/418/428, 14/63/242/283/286/306/317/414/415/418/428, 14/63/73/106/242/283/286/317/414/415/418/428, 12/14/63/242/258/263/283/286/289/308/309/317/396/414/418/428, 63/74/76/117/242/283/286/309/317/357/414/418/428, 14/63/242/258/263/283/286/317/357/396/414/418/428, 14/63/96/106/242/283/286/306/317/414/418/428, 14/63/106/242/283/286/317/414/418/428, 12/14/63/242/283/286/308/309/317/414/418/428, 14/63/242/283/286/317/357/390/414/418/428, 14/63/117/242/258/283/286/309/317/357/414/418/428, 63/242/283/286/317/390/414/418/428, 63/240/242/273/283/286/317/357/390/414/418/428, 61/63/76/186/201/242/283/286/308/309/317/414/418/428, 14/63/242/283/286/317/396/414/418/428, 63/242/283/286/309/317/414/418/428, 14/63/242/283/286/317/414/418/428, 63/106/242/283/286/306/308/317/414/418/428, 14/63/240/242/283/286/306/308/317/414/418/428, 12/14/63/186/242/283/286/317/357/414/418/428, 63/242/283/286/309/317/390/414/418/428, 14/63/242/283/286/306/317/414/418/428, 14/63/76/242/283/286/308/317/414/418/428, 63/117/208/242/258/263/283/286/289/308/309/317/414/418/428, 14/63/73/106/242/283/286/317/414/418/428, 63/76/208/242/263/283/286/317/414/418/428, 63/242/283/286/317/357/414/418/428, 14/63/242/283/286/308/317/414/418/428, 63/242/263/283/286/317/414/418/428, 63/76/242/283/286/317/414/418/428, 14/63/242/283/286/300/308/317/414/415/418/428, 63/240/242/283/286/317/414/418/428, 33/63/242/283/286/317/357/390/414/418/428, 14/63/76/242/273/283/286/317/414/418/428, or 63/74/242/283/286/317/414/418/428, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set 63R/242Q/283L/286S/308L/317Q/357S/390E/414Q/418S/428R, 63R/74S/76L/201S/242Q/283L/286S/308L/317Q/357P/414Q/418S/428R, 61T/63R/74S/76L/186A/201S/242Q/283L/286S/308L/309R/317Q/357P/390E/414Q/418S/428R, 14G/63R/201S/240R/242Q/283L/286S/289S/317Q/357P/414Q/418S/428R, 63R/242Q/283L/286S/308S/317Q/414Q/415I/418S/428R, 63R/76L/242Q/283L/286S/317Q/357S/396C/414Q/418S/428R, 63R/242Q/263L/283L/286S/308L/317Q/396C/414Q/418S/428R, 61T/63R/76L/96A/240R/242Q/283L/286S/308L/309R/317Q/414Q/418S/428R, 14S/63R/242Q/283L/286S/306I/317Q/414Q/415I/418S/428R, 14S/63R/73W/106S/242Q/283L/286S/317Q/414Q/415L/418S/428R, 12A/14G/63R/242Q/258S/263Q/283L/286S/289S/308L/309R/317Q/396C/414Q/418S/428R, 63R/74S/76L/Q117V/242Q/283L/286S/309R/317Q/357S/414Q/418S/428R, 14T/63R/242Q/258S/263Q/283L/286S/317Q/357S/396C/414Q/418S/428R, 14S/63R/96G/106S/242Q/283L/286S/306I/317Q/414Q/418S/428R, 14S/63R/106S/242Q/283L/286S/317Q/414Q/418S/428R, 12A/14G/63R/242Q/283L/286S/308L/309R/317Q/414Q/418S/428R, 14G/63R/242Q/283L/286S/317Q/357S/

390E/414Q/418S/428R, 14G/63R/117V/242Q/258S/283L/286S/309R/317Q/357S/414Q/418S/428R, 63R/242Q/283L/286S/317Q/390E/414Q/418S/428R, 63R/240R/242Q/273S/283L/286S/317Q/357P/390E/414Q/418S/428R, 61T/63R/76L/186V/201S/242Q/283L/286S/308L/309R/317Q/414Q/418S/428R, 14G/63R/242Q/283L/286S/317Q/396C/414Q/418S/428R, 63R/242Q/283L/286S/309R/317Q/414Q/418S/428R, 14S/63R/242Q/283L/286S/317Q/414Q/418S/428R, 63R/106V/242Q/283L/286S/306I/308S/317Q/414Q/418S/428R, 14S/63R/240S/242Q/283L/286S/306I/308S/317Q/414Q/418S/428R, 12I/14G/63R/186V/242Q/283L/286S/317Q/357S/414Q/418S/428R, 63R/242Q/283L/286S/309R/317Q/390E/414Q/418S/428R, 14S/63R/242Q/283L/286S/306I/317Q/414Q/418S/428R, 14T/63R/242Q/283L/286S/317Q/414Q/418S/428R, 14S/63R/76R/242Q/283L/286S/308S/317Q/414Q/418S/428R, 63R/117V/208D/242Q/258S/263Q/283L/286S/289S/308L/309R/317Q/414Q/418S/428R, 14S/63R/73W/106S/242Q/283L/286S/317Q/414Q/418S/428R, 63R/76L/208D/242Q/263Q/283L/286S/317Q/414Q/418S/428R, 63R/242Q/283L/286S/317Q/357S/414Q/418S/428R, 14S/63R/242Q/283L/286S/308S/317Q/414Q/418S/428R, 63R/242Q/263L/283L/286S/317Q/414Q/418S/428R, 63R/76L/242Q/283L/286S/317Q/414Q/418S/428R, 14S/63R/242Q/283L/286S/300G/308S/317Q/414Q/415I/418S/428R, 63R/240Y/242Q/283L/286S/317Q/414Q/418S/428R, 33M/63R/242Q/283L/286S/317Q/357S/390E/414Q/418S/428R, 14G/63R/76L/242Q/273S/283L/286S/317Q/414Q/418S/428R, or 63R/74S/242Q/283L/286S/317Q/414Q/418S/428R, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set of an engineered DNA ligase variant set forth in Table 18.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution at an amino acid position set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least one substitution set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set at amino acid position(s) set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the amino acid sequence of the engineered DNA ligase comprises at least a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence comprising a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938, wherein the amino acid sequence comprises one or more substitutions relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184, wherein the amino acid sequence comprises one or more substitutions relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution at amino acid position 11, 12, 13, 14, 18, 30, 31, 33, 34, 36, 37, 44, 50, 56, 59, 60, 61, 63, 67, 68, 69, 71, 73, 74, 76, 77, 82, 88, 95, 96, 97, 99, 100, 101, 102, 103, 104, 105, 106, 110, 112, 113, 117, 125, 128, 130, 132, 138, 139, 148, 149, 150, 155, 156, 159, 161, 162, 164, 165, 177, 186, 188, 189, 190, 191, 195, 196, 197, 198, 201, 205, 207, 208, 212, 220, 226, 228, 230, 231, 232, 233, 235, 237, 239, 240, 242, 251, 254, 258, 263, 264, 266, 267, 269, 271, 273, 277, 278, 282, 283, 284, 286, 288, 289, 290, 294, 295, 297, 300, 301, 305, 306, 308, 309, 317, 323, 328, 334, 337, 339, 349, 355, 356, 357, 358, 359, 360, 362, 364, 367, 370, 372, 374, 375, 378, 379, 380, 381, 382, 384, 386, 387, 388, 389, 390, 392, 396, 397, 404, 405, 408, 414, 415, 416, 417, 418, 419, 421, 422, 423, or 428, or combinations thereof, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution or an amino acid residue I1D, 12A/I, 13G/R, 14G/S/T/V, 18D/N/S, 30C/H/S, 31R, 33M/R/V, 34L/R, 36T/Y, 37G/L/N/S, 44S, 50G/I/S/T, 56P, 59E, 60Y, 61T/V, 63F/R, 67R, 68A/M/S/V/Y, 69T, 71G/L/P/R, 73C/K/P/T/V/W, 74S, 76F/G/H/L/N/R, 77D, 82R, 88V, 95A/L/R/V, 96A/G/T/V, 97G, 99G/I, 100V, 101R, 102G/K/L/S, 103V, 104K, 105K/S/T, 106L/S/V, 110R, 112M, 113A/T, 117G/S/V/Y, 125R/T, 128C, 130T, 132R, 138L/R, 139T, 148P, 149P, 150C/F/T, 155R, 156C, 159Q, 161R/V, 162W, 164A/R, 165K, 177G, 186A/C/E/H/L/M/R/T/V, 188A, 189C/T, 190R, 191T, 195R, 196E/V, 197R, 198A/D/K/L/N/R/V/W, 201L/S, 205E/G/K, 207L, 208D/F/H, 212F/G/M/S/W, 220V, 226D/E/Q/S/V, 228E/I/M/S, 230L/M, 231P, 232R, 233G/T/W, 235W, 237L/M/R/S/V/Y, 239M/N/P/Q/S/T/V/W, 240E/G/K/Q/R/S/Y, 242P/Q/T/V, 251L, 254G/S, 258L/S/V, 263G/L/Q/T, 264A/C, 266M/T, 267D/W/Y, 269L, 271A/G/N/S, 273A/G/S, 277Q/R, 278E, 282G/L/M/T/V/Y, 283A/F/G/K/L/M/R/S/V, 284D, 286F/L/S/W, 288I, 289A/L/S/V, 290L, 294L, 295K, 297W, 300G/T, 301F/L, 305K, 306I/K/SN, 308K/L/S, 309G, 317T/Q, 323S, 328R, 334L/R, 337G/L/M/P/R/S, 339Y, 349E, 355S, 356A/V/W, 357H/K/P/R/S/V, 358C, 359N/R, 360H/M/P, 362G, 364R, 367C/L, 370C/G, 372N/Q, 374A/S, 375W, 378T, 379A/G/P, 380T, 381K/R, 382V, 384C/V, 386F, 387G, 388K/Y, 389K/L/Q/R, 390E, 392C/I/K/L/R/S, 396C/H, 397K/L/M, 404S, 405I, 408C/V, 414A/L/Q/R/S/T/V, 415A/C/E/H/I/K/L/V, 416K, 417D/G/L, 418A/G/I/K/L/M/P/S/T, 419G, 421R, 422N, 423R/T, or 428E/F/R/S, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution at amino acid position 63, 242, 283, 286, 317, 414, 418, or 428, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938. In some embodiments, the amino acid sequence of the engineered DNA ligase comprises at least a substitution or an amino acid residue 63F/R, 242P/Q/T/V, 283A/F/G/K/L/M/R/S/V, 286F/L/S/W, 317T/Q, 414A/L/Q/R/S/T/V, 418A/G/I/K/L/M/P/S/T, or 428E/F/R/S, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938. In some embodiments, the amino acid sequence of the engineered DNA ligase comprises at least a substitution or an amino acid residue 63R, 242Q, 283L, 286S, 317Q, 414Q, 418S, or 428R, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, or to the reference sequence corresponding to SEQ ID NO: 62, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 68-312, or to the reference sequence corresponding to an even-numbered SEQ ID NO. of SEQ ID NOs: 68-312, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the amino acid sequence of the engineered DNA ligases comprises at least a substitution or substitution set at amino acid positions(s) 196, 242, 337, 33, 277, 30, 359, 283, 415, 387, 379, 205, 186, 389, 102, 164, 301, 375, 267, 380, 254, 317, 77/139/317/417, 105/317/417, 317/349/362/386, 105/317, 139/317/362, 233/317/405, 139/317, 162, 286, 414, 417, 226, 61, 105, 230, 418, 370, 297, 237, 428, 362, 233, 235, 148, 100, 97, 382, or 358, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the amino acid sequence of the engineered DNA ligases comprises at least a substitution or substitution set 196E, 242P, 337L, 33R, 33V, 277Q, 337P, 30C, 359N, 337G, 283S, 242Q, 415A, 387G, 415H, 379A, 205G, 186M, 337M, 389Q, 102L, 389L, 359R, 205K, 164A, 415E, 301F, 30H, 379G, 375W, 267W, 380T, 415C, 254G, 186T, 317Q, 77D/139T/317Q/417G, 105K/317Q/417G, 317Q/349E/362G/386F, 105K/317Q, 139T/317Q/362G, 233T/317Q/405I, 139T/317Q, 162W, 283V, 286S, 414L, 417L, 226S, 61T, 226Q, 105S, 186E, 230M, 61V, 186V, 186L, 379P, 415V, 415I, 186A, 283R, 226V, 418L, 418S, 370G, 283A, 337S, 297W, 237S, 428S, 186C, 362G, 283G, 196V, 237L, 415L, 233W, 242T, 277R, 235W, 148P, 254S, 102G, 105T, 301L, 286F, 100V, 237Y, 30S, 428F, 414Q, 414V, 283L, 414A, 414R, 370C, 283K, 286L, 186H, 417D, 226D, 233G, 267Y, 97G, 226E, 418T, 230L, 414T, 418A, 237V, 418G, 382V, 267D, 283M, 418P, 237R, 237M, 418I, 358C, 186R, 418M, or 102S, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the amino acid sequence of the engineered DNA ligase comprises at least a substitution or substitution set I196E, V242P, F337L, T33R, T33V, E277Q, F337P, T30C, K359N, F337G, F283S, V242Q, T415A, T387G, T415H, E379A, Q205G, K186M, F337M, E389Q, N102L, E389L, K359R, Q205K, K164A, T415E, E301F, T30H, E379G, Y375W, Q267W, V380T, T415C, H254G, K186T, T317Q, Y77D/S139T/T317Q/S417G, L105K/T317Q/S417G, T317Q/D349E/T362G/Y386F, L105K/T317Q, S139T/T317Q/T362G, S233T/I317Q/V405I, S139T/I317Q, Y162W, F283V, W286S, S414L, S417L, K226S, I61T, K226Q, L105S, K186E, V230M, I61V, K186V, K186L, E379P, T415V, T415I, K186A, F283R, K226V, K418L, K418S, A370G, F283A, F337S, F297W, K237S, R428S, K186C, T362G, F283G, I196V, K237L, T415L, S233W, V242T, E277R, F235W, I148P, H254S, N102G, L105T, E301L, W286F, T100V, K237Y, T30S, R428F, S414Q, S414V, F283L, S414A, S414R, A370C, F283K, W286L, K186H, S417D, K226D, S233G, Q267Y, R97G, K226E, K418T, V230L, S414T, K418A, K237V, K418G, I382V, Q267D, F283M, K418P, K237R, K237M, K418I, G358C, K186R, K418M, or N102S, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 138, or to the reference sequence corresponding to SEQ ID NO: 138, wherein the amino acid sequence comprises one or more substitutions relative to the reference sequence corresponding to residues 12 to 437 of SEQ ID NO: 138, or relative to the reference sequence corresponding to SEQ ID NO: 138.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 314-458, or to the reference sequence corresponding to an even-numbered SEQ ID NO. of SEQ ID NOs: 314-458, wherein the amino acid sequence comprises one or more substitutions relative to the reference sequence corresponding to residues 12 to 437 of SEQ ID NO: 138, or relative to the reference sequence corresponding to SEQ ID NO: 138.

In some embodiments, the amino acid sequence of the engineered DNA ligase comprises at least a substitution or substitution set at amino acid position(s) 242/283/286/359/418, 283/286, 283/286/418, 186/242/283/286/418, 205/286/359, 283, 242/286/418, 186/205/242, 283/286/359, 277/286/359/418, 186/205/283/286/359, 242/277/418, 242/283/286/418, 112/196/389, 286, 283/286/359/418, 242/359/418, 186/283, 186/359/418, 205/242/418, 186/205/242/283/286/359/418, 205/359/418, 186/205/283/286/418, 186/283/359, 186/242, 186/242/359, 283/359/418, 277/418, 186/188/283, 186/286/418, 186/242/286/359/418, 418, 186/242/283/286/359/418, 186/277/359/418, 242/283/286, 205/418, 30/297, 205/242/286/359/418, 186/205/359/418, 359/418, 186, 230, 33/297, 186/205, 186/283/359/418, 186/418, 205/242/283/359/418, 33/375/389, 33/230, 196/242/283/286/359/418, 186/242/283/359/418, 186/359, 33/196, 186/277/418, 242, 33/196/297/301, 205/237/242/283/286/359, 186/205/283/359/418, 33/389, or 186/196/242/283/286/359/418, wherein the amino acid positions are relative to the reference sequence corresponding to residues 12 to 437 of SEQ ID NO: 138, or relative to the reference sequence corresponding to SEQ ID NO: 138.

In some embodiments, the amino acid sequence of the engineered DNA ligase comprises at least a substitution or substitution set 242Q/283V/286S/359R/418L, 283L/286S, 283L/286S/418S, 186E/242Q/283V/286S/418L, 205K/286S/359R, 283V, 242P/286S/418T, 186E/205K/242T, 283L/286S/359R, 277Q/286S/359N/418T, 186A/205K/283V/286S/359R, 242Q/277Q/418L, 242Q/283S/286S/418T, 112M/196V/389Q, 286S, 242P/283R/286S/359R/418L, 283L/286S/359R/418S, 242Q/359N/418S, 186E/283L, 186E/359R/418S, 205K/242T/418S, 186E/205K/242Q/283S/286S/359R/418S, 205K/359N/418L, 186A/205K/283L/286S/418L, 242T/283V/286S/359R/418S, 186E/283L/359R, 186E/242P, 283V/286S/418S, 186E/242T/359R, 283L/359R/418L, 277Q/418S, 186E/188A/283V, 186E/286S/418S, 186A/242T/286S/359N/418L, 418L, 186A/242P/283V/286S/359R/418S, 186A/277Q/359R/418S, 242Q/283R/286S, 205K/418S, 30C/297W, 283L/359R/418S, 186E/286S/418L, 418T, 205K/242T/286S/359R/418S, 186E/205K/359N/418T, 418S, 186E/242T/283S/286S/418S, 359R/418S, 242T/286S/418S, 186E, 230L, 33V/297W, 186E/205K, 186A/283L/359R/418S, 186E/418L, 186E/277Q/359R/418S, 205K/242T/283R/359R/418L, 186E/418T, 33V/375W/389Q, 33R/230L, 196E/242T/283V/286S/359R/418T, 186E/242T/283L/359R/418S, 186E/359R, 33V/196V, 33R/375W/389Q, 186A/277Q/418S, 186A/242T/283L/286S/418L, 242T, 33V/196V/297W/301F, 205K/237Y/242P/283L/286S/359R, 186A/205K/283L/359R/418T, 33V/389Q, or 186A/196E/242T/283L/286S/359N/418T, wherein the amino acid positions are relative to the reference sequence corresponding to residues 12 to 437 of SEQ ID NO: 138, or relative to the reference sequence corresponding to SEQ ID NO: 138.

In some embodiments, the amino acid sequence of the engineered DNA ligase comprises at least a substitution or substitution set V242Q/F283V/W286S/K359R/K418L, F283L/W286S, F283L/W286S/K418S, K186E/V242Q/F283V/W286S/K418L, Q205K/W286S/K359R, F283V, V242P/W286S/K418T, K186E/Q205K/V242T, F283L/W286S/K359R, E277Q/W286S/K359N/K418T, K186A/Q205K/F283V/W286S/K359R, V242Q/E277Q/K418L, V242Q/F283S/W286S/K418T, L112M/I196V/E389Q, W286S, V242P/F283R/W286S/K359R/K418L, F283L/W286S/K359R/K418S, V242Q/K359N/K418S, K186E/F283L, K186E/K359R/K418S, Q205K/V242T/K418S, K186E/Q205K/V242Q/F283S/W286S/K359R/K418S, Q205K/K359N/K418L, K186A/Q205K/F283L/W286S/K418L, V242T/F283V/W286S/K359R/K418S, K186E/F283L/K359R, K186E/V242P, F283V/W286S/K418S, K186E/V242T/K359R, F283L/K359R/K418L, E277Q/K418S, K186E/V188A/F283V, K186E/W286S/K418S, K186A/V242T/W286S/K359N/K418L, K418L, K186A/V242P/F283V/W286S/K359R/K418S, K186A/E277Q/K359R/K418S, V242Q/F283R/W286S, Q205K/K418S, T30C/F297W, F283L/K359R/K418S, K186E/W286S/K418L, K418T, Q205K/V242T/W286S/K359R/K418S, K186E/Q205K/K359N/K418T, K418S, K186E/V242T/F283S/W286S/K418S, K359R/K418S, V242T/W286S/K418S, K186E, V230L, T33V/F297W, K186E/Q205K, K186A/F283L/K359R/K418S, K186E/K418L, K186E/E277Q/K359R/K418S, Q205K/V242T/F283R/K359R/K418L, K186E/K418T, T33V/Y375W/E389Q, T33R/V230L, I196E/V242T/F283V/W286S/K359R/K418T, K186E/V242T/F283L/K359R/K418S, K186E/K359R, T33V/I196V, T33R/Y375W/E389Q, K186A/E277Q/K418S, K186A/V242T/F283L/W286S/K418L, V242T, T33V/I196V/F297W/E301F, Q205K/K237Y/V242P/

F283L/W286S/K359R, K186A/Q205K/F283L/K359R/K418T, T33V/E389Q, or K186A/I196E/V242T/F283L/W286S/K359N/K418T, wherein the amino acid positions are relative to the reference sequence corresponding to residues 12 to 437 of SEQ ID NO: 138, or relative to the reference sequence corresponding to SEQ ID NO: 138.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 318, or to the reference sequence corresponding to SEQ ID NO: 318, wherein the amino acid sequence comprises one or more substitutions relative to the reference sequence corresponding to residues 12 to 437 of SEQ ID NO: 318, or relative to the reference sequence corresponding to SEQ ID NO: 318.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 460-936, or to the reference sequence corresponding to an even-numbered SEQ ID NO. of SEQ ID NOs: 460-936, wherein the amino acid sequence comprises one or more substitutions relative to the reference sequence corresponding to residues 12 to 437 of SEQ ID NO: 318, or relative to the reference sequence corresponding to SEQ ID NO: 318.

In some embodiments, the amino acid sequence of the engineered DNA ligases comprises at least a substitution or substitution set at amino acid positions(s) 363, 63, 389, 381, 197, 359, 102, 165, 388, 414, 337, 164, 416, 101, 415, 423, 364, 73, 50, 71, 388/419, 357, 396, 68, 76, 14, 271, 360, 266, 208, 74, 263, 264, 13, 378, 372, 300, 294, 290, 397, 95, 258, 161, 212, 198, 138, 18, 404, 273, 117, 240, 69, 278, 289, 82, 328, 61/186/417, 186/370/417, 267, 61/370, 186/267/370/417, 61/186, 370/417, 417, 61/370/382, 61/186/267/370/417, 61, 267/370/417, 267/370, 61/417, 61/186/237/267/370, 61/237/370/417, 370, 186/370, 61/186/267/417, 61/186/370/382, 370/382/417, 61/186/370, 237/267/370/417, 61/186/382, 61/267, 61/267/417, 61/237/267/382, 186/370/382, 237/267/370, 61/186/267/370, 186/237/267/370, 61/186/267, 61/186/237, 186, 186/267, 237/370/417, 242/414, 162/414, 267/414, 105/414, 162/242/414, 97/162/414, 105/162/267/414, 356, 392, 106, 308, 306, 96, 282, 113, 309, 110, 37, 201, 284, 374, 295, 88, 44, 12, or 390, wherein the amino acid positions are relative to the reference sequence corresponding to residues 12 to 437 of SEQ ID NO: 318, or relative to the reference sequence corresponding to SEQ ID NO: 318.

In some embodiments, the amino acid sequence of the engineered DNA ligases comprises at least a substitution or substitution set 363R, 63R, 389K, 381R, 389R, 197R, 359R, 381K, 102K, 165K, 388K, 414R, 337R, 164R, 416K, 101R, 415K, 423R, 364R, 73P, 50I, 71L, 388Y/419G, 50G, 357K, 396H, 68Y, 76F, 71P, 14V, 271G, 68A, 68M, 360P, 266M, 208D, 74S, 263T, 264C, 13R, 263L, 360M, 378T, 76H, 13G, 76R, 50T, 372Q, 50S, 300G, 73T, 294L, 372N, 76N, 290L, 397L, 76G, 95L, 258L, 161V, 212M, 198V, 138L, 18D, 18S, 404S, 273G, 117G, 240E, 68S, 73C, 69T, 278E, 360H, 198D, 300T, 161R, 73K, 289V, 82R, 328R, 61T/186A/417D, 186A/370C/417L, 267Y, 61T/370C, 186A/267Y/370C/417L, 61T/186C, 370C/417D, 417D, 61T/370C/382V, 61T/186A/267Y/370C/417D, 61T, 267Y/370C/417D, 267Y/370C, 61T/417L, 61T/186H/237R/267Y/370C, 61T/237R/370C/417L, 370C/417L, 370C, 186E/370C, 61T/186E/267Y/417D, 61T/186C/370C/382V, 370C/382V/417D, 61T/186C/267Y/417D, 61T/186C/370C, 237R/267Y/370C/417D, 61T/186E/417D, 61T/186H, 61T/186C/382V, 61T/186H/370C, 61T/267Y, 61T/267Y/417L, 61T/237R/267Y/382V, 186H/370C/382V, 237R/267Y/370C, 186H/370C/417D, 61T/186V/267Y/370C, 267Y/370C/417L, 61T/186V/370C, 186H/237R/267Y/370C, 61T/186E/267Y, 61T/186C/237R, 61T/186H/237R, 61T/186C/417L, 186H, 186A/267Y, 186C/370C, 61T/186C/237R/267Y/370C, 186E/267Y, 237R/370C/417L, 186H/370C, 242Q/414Q, 414T, 414Q, 162W/414Q, 162W/414V, 267D/414T, 414V, 267D/414Q, 414A, 162W/414L, 105S/414T, 162W/242Q/414T, 97G/162W/414Q, 105S/162W/267D/414V, 356V, 273A, 357P, 14G, 14S, 396C, 240R, 392K, 273S, 106V, 308S, 308L, 306I, 96A, 397K, 263Q, 282T, 138R, 258S, 76L, 14T, 289S, 240G, 106S, 117S, 357S, 96G, 113T, 71G, 282V, 117V, 282M, 258V, 309G, 306K, 308K, 357R, 212S, 18N, 113A, 306S, 212F, 198N, 110R, 240K, 198L, 71R, 357V, 198R, 271A, 282Y, 212G, 95V, 37S, 68V, 240S, 117Y, 201S, 271N, 240Q, 289L, 212W, 198W, 357H, 208F, 282L, 306V, 284D, 96T, 266T, 374S, 95R, 309R, 73W, 397M, 289A, 295K, 106L, 95A, 374A, 88V, 96V, 271S, 44S, 208H, 263G, 12A, 201L, 198A, 198K, 282G, 390E, 264A, or 73V, wherein the amino acid positions are relative to the reference sequence corresponding to residues 12 to 437 of SEQ ID NO: 318, or relative to the reference sequence corresponding to SEQ ID NO: 318.

In some embodiments, the amino acid sequence of the engineered DNA ligase comprises at least a substitution or substitution set K363R, G63R, E389K, S381R, E389R, I197R, K359R, S381K, N102K, R165K, D388K, S414R, F337R, K164R, S416K, G101R, T415K, S423R, N364R, L73P, E50I, K71L, D388Y/T419G, E50G, E357K, A396H, I68Y, D76F, K71P, K14V, F271G, I68A, I68M, E360P, E266M, A208D, P74S, R263T, I264C, T13R, R263L, E360M, N378T, D76H, T13G, D76R, E50T, V372Q, E50S, S300G, L73T, D294L, V372N, D76N, W290L, R397L, D76G, Y95L, A258L, K161V, V212M, T198V, K138L, Q18D, Q18S, K404S, R273G, Q117G, D240E, I68S, L73C, K69T, Q278E, E360H, T198D, S300T, K161R, L73K, E289V, D82R, D328R, I61T/K186A/S417D, K186A/A370C/S417L, Q267Y, I61T/A370C, K186A/Q267Y/A370C/S417L, I61T/K186C, A370C/S417D, S417D, I61T/A370C/I382V, I61T/K186A/Q267Y/A370C/S417D, I61T, Q267Y/A370C/S417D, Q267Y/A370C, I61T/S417L, I61T/K186H/K237R/Q267Y/A370C, I61T/K237R/A370C/S417L, A370C/S417L, A370C, K186E/A370C, I61T/K186E/Q267Y/S417D, I61T/K186C/A370C/I382V, A370C/I382V/S417D, I61T/K186C/Q267Y/S417D, I61T/K186C/A370C, K237R/Q267Y/A370C/S417D, I61T/K186E/S417D, I61T/K186H, I61T/K186C/I382V, I61T/K186H/A370C, I61T/Q267Y, I61T/Q267Y/S417L, I61T/K237R/Q267Y/I382V, K186H/A370C/I382V, K237R/Q267Y/A370C, K186H/A370C/S417D, I61T/K186V/Q267Y/A370C, Q267Y/A370C/S417L, I61T/K186V/A370C, K186H/K237R/Q267Y/A370C, I61T/K186E/Q267Y, I61T/K186C/K237R, I61T/K186H/K237R, I61T/K186C/S417L, K186H, K186A/Q267Y, K186C/A370C, I61T/K186C/K237R/Q267Y/A370C, K186E/Q267Y, K237R/A370C/S417L, K186H/A370C, V242Q/S414Q, S414T, S414Q, Y162W/S414Q, Y162W/S414V, Q267D/S414T, S414V, Q267D/S414Q, S414A, Y162W/S414L, L105S/S414T, Y162W/V242Q/S414T, R97G/Y162W/S414Q, L105S/Y162W/Q267D/S414V, E356V, R273A, E357P, K14G, K14S, A396C, D240R, V392K, R273S, D106V, F308S, F308L, E306I, N96A, R397K, R263Q, E282T, K138R, A258S, D76L, K14T, E289S, D240G, D106S, Q117S, E357S, N96G, S113T, K71G, E282V, Q117V, E282M, A258V, H309G, E306K, F308K, E357R, V212S, Q18N, S113A, E306S, V212F, T198N, V110R, D240K, T198L, K71R, E357V, T198R, F271A, E282Y, V212G, Y95V, D37S, I68V, D240S, Q117Y, T201S, F271N, D240Q, E289L, V212W, T198W, E357H, A208F, E282L, E306V, P284D, N96T, E266T, E374S, Y95R, H309R, L73W, R397M, E289A, G295K, D106L, Y95A, E374A, L88V, N96V, F271S, D44S, A208H, R263G, M12A, T201L, T198A, T198K, E282G, M390E, I264A, or L73V, wherein the amino acid positions are relative to the reference sequence corresponding to residues 12 to 437 of SEQ ID NO: 318, or relative to the reference sequence corresponding to SEQ ID NO: 318.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 722, or to the reference sequence corresponding to SEQ ID NO: 722, wherein the amino acid sequence comprises one or more substitutions relative to the reference sequence corresponding to residues 12 to 437 of SEQ ID NO: 722, or relative to the reference sequence corresponding to SEQ ID NO: 722.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 938-1098, or to the reference sequence corresponding to an even-numbered SEQ ID NO. of SEQ ID NOs: 938-1098, wherein the amino acid sequence comprises one or more substitutions relative to the reference sequence corresponding to residues 12 to 437 of SEQ ID NO: 722, or relative to the reference sequence corresponding to SEQ ID NO: 722.

In some embodiments, the amino acid sequence of the engineered DNA ligases comprises at least a substitution or substitution set at amino acid positions(s) 63, 63/96/370, 389, 13/267/363/389, 13/186/389, 50/267/363/370/389, 363/370, 96/370, 61/63/212, 11/305, 11, 242/283/286/317/414/418, 323, 334, 339, 356, 384, 408, 67, 392, 104, 355, 159, 155, 367, 31, 231, 36, 150, 239, 103, 125, 228, 37, 189, 177, 422, 128, 220, 130, 56, 190, 156, 232, 423, 34, 99, 59, 60, 421, or 195, wherein the amino acid positions are relative to the reference sequence corresponding to residues 12 to 437 of SEQ ID NO: 722, or relative to the reference sequence corresponding to SEQ ID NO: 722.

In some embodiments, the amino acid sequence of the engineered DNA ligases comprises at least a substitution or substitution set 63R, 63R/96T/370C, 389K, 13R/267Y/363R/389K, 13R/186H/389K, 50T/267Y/363R/370C/389K, 363R/370C, 96T/370C, 61T/63R/212W, 11D/305K, 11D, 242V/283F/286W/317T/414S/418K, 323S, 334L, 339Y, 356V, 384V, 408C, 67R, 392R, 104K, 355S, 159Q, 155R, 367L, 31R, 231P, 36Y, 150T, 239V, 103V, 356A, 63F, 125T, 367C, 228I, 37S, 37G, 239M, 239W, 239Q, 189C, 239S, 239T, 177G, 239P, 37N, 422N, 228S, 125R, 128C, 189T, 356W, 220V, 408V, 392S, 130T, 228M, 56P, 228E, 190R, 392I, 156C, 232R, 150F, 150C, 239N, 392L, 423T, 34L, 99I, 384C, 59E, 334R, 60Y, 99G, 34R, 37L, 392C, 421R, or 195R, wherein the amino acid positions are relative to the reference sequence corresponding to residues 12 to 437 of SEQ ID NO: 722, or relative to the reference sequence corresponding to SEQ ID NO: 722.

In some embodiments, the amino acid sequence of the engineered DNA ligase comprises at least a substitution or substitution set G63R, G63R/N96T/A370C, E389K, T13R/Q267Y/K363R/E389K, T13R/K186H/E389K, E50T/Q267Y/K363R/A370C/E389K, K363R/A370C, N96T/A370C, I61T/G63R/V212W, G11D/Q305K, G11D, Q242V/L283F/S286W/Q317T/Q414S/S418K, M323S, K334L, I339Y, E356V, G384V, I408C, K67R, V392R, A104K, F355S, L159Q, L155R, V367L, S31R, Q231P, E36Y, E150T, D239V, A103V, E356A, G63F, K125T, V367C, A228I, D37S, D37G, D239M, D239W, D239Q, L189C, D239S, D239T, C177G, D239P, D37N, K422N, A228S, K125R, Q128C, L189T, E356W, I220V, I408V, V392S, D130T, A228M, Y56P, A228E, K190R, V392I, A156C, K232R, E150F, E150C, D239N, V392L, S423T, A34L, L99I, G384C, D59E, K334R, L60Y, L99G, A34R, D37L, V392C, K421R, or K195R, wherein the amino acid positions are relative to the reference sequence corresponding to residues 12 to 437 of SEQ ID NO: 722, or relative to the reference sequence corresponding to SEQ ID NO: 722.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 938, or to the reference sequence corresponding to SEQ ID NO: 938, wherein the amino acid sequence comprises one or more substitutions relative to the reference sequence corresponding to residues 12 to 437 of SEQ ID NO: 938, or relative to the reference sequence corresponding to SEQ ID NO: 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 1100-1184, or to the reference sequence corresponding to an even-numbered SEQ ID NO. of SEQ ID NOs: 1100-1184, wherein the amino acid sequence comprises one or more substitutions relative to the reference sequence corresponding to residues 12 to 437 of SEQ ID NO: 938, or relative to the reference sequence corresponding to SEQ ID NO: 938.

In some embodiments, the amino acid sequence of the engineered DNA ligases comprises at least a substitution or substitution set at amino acid positions(s) 308/357/390, 74/76/201/308/357, 61/74/76/186/201/308/309/357/390, 14/201/240/289/357, 308/415, 76/357/396, 263/308/396, 61/76/96/240/308/309, 14/306/415, 14/73/106/415, 12/14/258/263/289/308/309/396, 74/76/117/309/357, 14/258/263/357/396, 14/96/106/306, 14/106, 12/14/308/309, 14/357/390, 14/117/258/309/357, 390, 240/273/357/390, 61/76/186/201/308/309, 14/396, 309, 14, 106/306/308, 14/240/306/308, 12/14/186/357, 309/390, 14/306, 14/76/308, 117/208/258/263/289/308/309, 14/73/106, 76/208/263, 357, 14/308, 263, 76, 14/300/308/415, 240, 33/357/390, 14/76/273, or 74, wherein the amino acid positions are relative to the reference sequence corresponding to residues 12 to 437 of SEQ ID NO: 938, or relative to the reference sequence corresponding to SEQ ID NO: 938.

In some embodiments, the amino acid sequence of the engineered DNA ligases comprises at least a substitution or substitution set 308L/357S/390E, 74S/76L/201S/308L/357P, 61T/74S/76L/186A/201S/308L/309R/357P/390E, 14G/201S/240R/289S/357P, 308S/415I, 76L/357S/396C, 263L/308L/396C, 61T/76L/96A/240R/308L/309R, 14S/306I/415I, 14S/73W/106S/415I, 12A/14G/258S/263Q/289S/308L/309R/396C, 74S/76L/117V/309R/357S, 14T/258S/263Q/357S/396C, 14S/96G/106S/306I, 14S/106S, 12A/14G/308L/309R, 14G/357S/390E, 14G/117V/258S/309R/357S, 390E, 240R/273S/357P/390E, 61T/76L/186V/201S/308L/309R, 14G/396C, 309R, 14S, 106V/306I/308S, 14S/240S/306I/308S, 12I/14G/186V/357S, 309R/390E, 14S/306I, 14T, 14S/76R/308S, 117V/208D/258S/263Q/289S/308L/309R, 14S/73W/106S, 76L/208D/263Q, 357S, 14S/308S, 263L, 76L, 14S/300G/308S/415I, 240Y, 33M/357S/390E, 14G/76L/273S, or 74S, wherein the amino acid positions are relative to the reference sequence corresponding to residues 12 to 437 of SEQ ID NO: 938, or relative to the reference sequence corresponding to SEQ ID NO: 938.

In some embodiments, the amino acid sequence of the engineered DNA ligase comprises at least a substitution or substitution set F308L/E357S/M390E, P74S/D76L/T201S/F308L/E357P, I61T/P74S/D76L/K186A/T201S/F308L/H309R/E357P/M390E, K14G/T201S/D240R/E289S/E357P, F308S/T415I, D76L/E357S/A396C, R263L/F308L/A396C, I61T/D76L/N96A/D240R/F308L/H309R, K14S/E306I/T415I, K14S/L73W/D106S/T415I, M12A/K14G/A258S/R263Q/E289S/F308L/H309R/A396C, P74S/D76L/Q117V/H309R/E357S, K14T/A258S/R263Q/E357S/A396C, K14S/N96G/D106S/E306I, K14S/D106S, M12A/K14G/F308L/H309R, K14G/E357S/M390E, K14G/Q117V/A258S/H309R/E357S, M390E, D240R/R273S/E357P/M390E, I61T/D76L/K186V/T201S/F308L/H309R, K14G/A396C, H309R, K14S, D106V/E306I/F308S, K14S/D240S/E306I/F308S, M12I/K14G/K186V/E357S, H309R/M390E, K14S/E306I, K14T, K14S/D76R/F308S, Q117V/A208D/A258S/R263Q/E289S/F308L/H309R, K14S/L73W/D106S, D76L/A208D/R263Q, E357S, K14S/F308S, R263L, D76L, K14S/S300G/F308S/T415I, D240Y, T33M/E357S/M390E, K14G/D76L/R273S, or P74S, wherein the amino acid positions are relative to the reference sequence corresponding to residues 12 to 437 of SEQ ID NO: 938, or relative to the reference sequence corresponding to SEQ ID NO: 938.

In some embodiments, the amino acid sequence of the engineered DNA ligase comprises at least a substitution at an amino acid position set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least one substitution set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution or substitution set at amino acid position(s) set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the amino acid sequence of the engineered DNA ligase comprises at least a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence comprising a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a sequence corresponding to residues 12 to 437 of an engineered DNA ligase variant set forth in Tables 9.2, 10.2, 11.2, 12.2, 13.2, 14.2, 15.2, 16.2, 17.2, and 18.2, or to a sequence corresponding to an engineered DNA ligase variant set forth in Tables 9.2, 10.2, 11.2, 12.2, 13.2, 14.2, 15.2, 16.2, 17.2, and 18.2.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to the sequence corresponding to residues 12 to 437 of SEQ ID NO: 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 700, 702, 704, 706, 708, 710, 712, 714, 716, 718, 720, 722, 724, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, or 1184.

In some embodiments, the engineered DNA ligase comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the sequence corresponding to SEQ ID NO: 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 700, 702, 704, 706, 708, 710, 712, 714, 716, 718, 720, 722, 724, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, or 1184.

In some embodiments, the engineered DNA ligase comprises an amino acid sequence comprising residues 12 to 437 of an even numbered SEQ ID NO. of SEQ ID NOs: 40-1184, or an amino acid sequence comprising an even numbered SEQ ID NO. of SEQ ID NOs: 40-1184. In some embodiments, the amino acid sequence of the engineered DNA ligase optionally includes 1, 2, 3, 4, 5, 6, 7, 8, 9, or up to 10 substitutions, insertions, and/or deletions. In some embodiments, the amino acid sequence of the engineered DNA ligase optionally includes 1, 2, 3, 4, 5, 6, 7, 8, 9, or up to 10 substitutions. In some embodiments, the amino acid sequence of the engineered DNA ligase optionally includes 1, 2, 3, 4, or 5 substitutions, insertions, and/or deletions. In some embodiments, the amino acid sequence of the engineered DNA ligase optionally includes 1, 2, 3, 4, or 5 substitutions.

In some embodiments, the engineered DNA ligase comprises an amino acid sequence comprising residues 12 to 437 of SEQ ID NO: 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480,482, 484, 486, 488, 490, 492, 494, 496,498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 700, 702, 704, 706, 708, 710, 712, 714, 716, 718, 720, 722, 724, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, or 1184. In some embodiments, the amino acid sequence of the engineered DNA ligase optionally includes 1, 2, 3, 4, 5, 6, 7, 8, 9, or up to 10 substitutions, insertions, and/or deletions. In some embodiments, the amino acid sequence of the engineered DNA ligase optionally includes 1, 2, 3, 4, 5, 6, 7, 8, 9, or up to 10 substitutions. In some embodiments, the amino acid sequence of the engineered DNA ligase optionally includes 1, 2, 3, 4, or 5 substitutions, insertions, and/or deletions. In some embodiments, the amino acid sequence of the engineered DNA ligase optionally includes 1, 2, 3, 4, or 5 substitutions.

In some embodiments, the engineered DNA ligase comprises an amino acid sequence comprising SEQ ID NO: 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490,492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 700, 702, 704, 706, 708, 710, 712, 714, 716, 718, 720, 722, 724, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, or 1184. In some embodiments, the amino acid sequence of the engineered DNA ligase optionally includes 1, 2, 3, 4, 5, 6, 7, 8, 9, or up to 10 substitutions, insertions, and/or deletions. In some embodiments, the amino acid sequence of the engineered DNA ligase optionally includes 1, 2, 3, 4, 5, 6, 7, 8, 9, or up to 10 substitutions. In some embodiments, the amino acid sequence of the engineered DNA ligase optionally includes 1, 2, 3, 4, or 5 substitutions, insertions, and/or deletions. In some embodiments, the amino acid sequence of the engineered DNA ligase optionally includes 1, 2, 3, 4, or 5 substitutions.

In some embodiments, the engineered DNA ligase comprises an amino acid sequence comprising residues 12 to 437 of SEQ ID NO: 62, 138, 318, 722, or 938, or an amino acid sequence comprising SEQ ID NO: 62, 138, 318, 722, or 938. In some embodiments, the amino acid sequence of the engineered DNA ligase optionally includes 1, 2, 3, 4, 5, 6, 7, 8, 9, or up to 10 substitutions, insertions, and/or deletions. In some embodiments, the amino acid sequence of the engineered DNA ligase optionally includes 1, 2, 3, 4, 5, 6, 7, 8, 9, or up to 10 substitutions. In some embodiments, the amino acid sequence of the engineered DNA ligase optionally includes 1, 2, 3, 4, or 5 substitutions, insertions, and/or deletions. In some embodiments, the amino acid sequence of the engineered DNA ligase optionally includes 1, 2, 3, 4, or 5 substitutions.

In some of the foregoing embodiments, the engineered DNA ligase polypeptide has 1, 2, 3, 4, or up to 5 substitutions in the amino acid sequence. In some embodiments, the engineered DNA ligase polypeptide has 1, 2, 3, or 4 substitutions in the amino acid sequence. In some embodiments, the substitutions comprises non-conservative or conservative substitutions. In some embodiments, the substitutions comprises conservative substitutions. In some embodiments, the substitutions comprises non-conservative substitutions.

In some embodiments, guidance on non-conservative and conservative substitutions are provided by the variants disclosed herein.

In some embodiments, the engineered DNA ligase of the present disclosure has DNA ligase activity. In some embodiments, the engineered DNA ligase has DNA ligase activity and is characterized by or displays one or more improved or enhanced properties described herein as compared to a reference DNA ligase.

In some embodiments, the engineered DNA ligase has increased activity as compared to the reference DNA ligase. In some embodiments, the increased activity is about 1.1-fold, 1.2-fold, 1.3-fold, 1.4-fold, 1.5-fold, 2-fold, 2.5-fold, 3-fold, 4-fold, 5-fold, 6-fold, 7-fold, 8-fold, 9-fold, 10-fold, 15-fold, 20-fold, or more compared to the reference DNA ligase. Exemplary activity improvements are provided in the Examples.

In some embodiments, the engineered DNA ligase has increased stability as compared to the reference DNA ligase. In some embodiments, the engineered DNA ligase has increased thermostability as compared to the reference DNA ligase. In some embodiments, the increased thermostability is at temperature from about 25° C. to 55° C., about 30° C. to about 45° C., 35° C. to about 40° C., in particular from about 40° C. to about 50° C. In some embodiments, the increased thermostability is at 25° C., 30° C., 35° C., 40° C., 41° C., 42° C., 43° C., 44° C., 45° C., 46° C., 47° C., 48° C., 49° C., or 50° C. In some embodiments, the increased thermostability is at a specified temperature and treated for 15 min, 30 min, 45 min, or 1 hr.

In some embodiments, the engineered DNA ligase has increased product yield as compared to the reference DNA ligase. In some embodiments, the increase in product yield is under substrate and reaction conditions provided in the Examples.

In some embodiments, the engineered DNA ligase has increased solubility as compared to the reference DNA ligase. In some embodiments, the engineered DNA ligase has reduced sequence bias as compared to the reference DNA ligase. In some embodiments, the engineered DNA ligase is insensitive or has reduced sensitivity to input DNA substrate concentrations.

In some embodiments, the reference DNA ligase has the sequence corresponding to residues 12 to 437 of SEQ ID NO: 62, 138, 318, 722, 938 or 1108, or the sequence corresponding to SEQ ID NO: 62, 138, 318, 722, 938, or 1108. In some embodiments, the reference DNA ligase has the sequence corresponding to residues 12 to 437 of SEQ ID NO: 2, or the sequence corresponding to SEQ ID NO: 2. In some embodiments, the reference DNA ligase is wild-type T4 DNA ligase.

In some embodiments, the engineered DNA ligase has an improved property selected from i) increased activity, ii) increased stability, iii) increased thermostability, iv) increased product yield, v) increased solubility, vi) reduced sequence bias, and vii) insensitive or has reduced sensitivity to input DNA substrate concentrations, or any combination of i), ii), iii), iv), v), vi), and vii) compared to a reference DNA ligase. In some embodiments, the reference DNA ligase has the sequence corresponding to residues 12 to 437 of SEQ ID NO: 2, 62, 138, 318, 722, or 938, or the sequence corresponding to SEQ ID NO: 2, 62, 138, 318, 722, or 938. In some embodiments, the reference DNA ligase has the sequence corresponding to residues 12 to 437 of SEQ ID NO: 2, or the sequence corresponding to SEQ ID NO: 2. In some embodiments, the reference DNA ligase is wild-type T4 DNA ligase.

In some embodiments, the present disclosure further provides an engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to (a) a sequence corresponding to residues 12 to 437 of SEQ ID NO: 2, a sequence corresponding to residues 12 to 613 of SEQ ID NO: 4, residues 12 to 614 of SEQ ID NO: 6, residues 12 to 610 of SEQ ID NO: 8, residues 12 to 606 of SEQ ID NO: 10, residues 12 to 615 of SEQ ID NO: 12, residues 12 to 594 of SEQ ID NO: 14, residues 12 to 620 of SEQ ID NO: 16, residues 12 to 608 of SEQ ID NO: 18, residues 12 to 611 of SEQ ID NO: 20, residues 12 to 614 of SEQ ID NO: 22, residues 12 to 611 of SEQ ID NO: 24, residues 12 to 609 of SEQ ID NO: 26, residues 12 to 422 of SEQ ID NO: 28, residues 12 to 518 of SEQ ID NO: 30, residues 12 to 438 of SEQ ID NO: 32, residues 12 to 381 of SEQ ID NO: 34, residues 12 to 424 of SEQ ID NO: 36, or residues 12 to 390 of SEQ ID NO: 38; or (b) a sequence corresponding to SEQ ID NO: 2, 4, 6, 8, 10, 12, 14, 16, 18, 20, 22, 24, 26, 28, 30, 32, 34, 36, or 38.

In some embodiments, the engineered DNA ligase comprises an amino acid sequence (a) comprising residues 12 to 437 of SEQ ID NO: 2, residues 12 to 613 of SEQ ID NO: 4, residues 12 to 614 of SEQ ID NO: 6, residues 12 to 610 of SEQ ID NO: 8, residues 12 to 606 of SEQ ID NO: 10, residues 12 to 615 of SEQ ID NO: 12, residues 12 to 594 of SEQ ID NO: 14, residues 12 to 620 of SEQ ID NO: 16, residues 12 to 608 of SEQ ID NO: 18, residues 12 to 611 of SEQ ID NO: 20, residues 12 to 614 of SEQ ID NO: 22, residues 12 to 611 of SEQ ID NO: 24, residues 12 to 609 of SEQ ID NO: 26, residues 12 to 422 of SEQ ID NO: 28, residues 12 to 518 of SEQ ID NO: 30, residues 12 to 438 of SEQ ID NO: 32, residues 12 to 381 of SEQ ID NO: 34, residues 12 to 424 of SEQ ID NO: 36, or residues 12 to 390 of SEQ ID NO: 38; or (b) comprising SEQ ID NO: 2, 4, 6, 8, 10, 12, 14, 16, 18, 20, 22, 24, 26, 28, 30, 32, 34, 36, or 38.

In some embodiments, the engineered DNA ligase is expressed as a fusion protein. In some embodiments, the engineered DNA ligase described herein can be fused to a variety of polypeptide sequences, such as, by way of example and not limitation, polypeptide tags that can be used for detection and/or purification. In some embodiments, the fusion protein of the engineered DNA ligase comprises a glycine-histidine or histidine-tag (His-tag). In some embodiments, the fusion protein of the engineered DNA ligase comprises an epitope tag, such as c-myc, FLAG, V5, or hemagglutinin (HA). In some embodiments, the fusion protein of the engineered DNA ligase comprises a GST, SUMO, Strep, MBP, or GFP tag. In some embodiments, the fusion is to the amino (N—) terminus of engineered DNA ligase polypeptide. In some embodiments, the fusion is to the carboxy (C—) terminus of the engineered DNA ligase polypeptide.

In some embodiments, the engineered DNA ligase polypeptide described herein is an isolated composition. In some embodiments, the engineered DNA ligase polypeptide is purified or is a purified preparation, as further discussed herein.

In some embodiments, the present disclosure further provides functional fragments or biologically active fragments of the engineered DNA ligase polypeptides described herein. Thus, for each and every embodiment herein of an engineered DNA ligase, a functional fragment or biologically active fragment of the engineered DNA ligase is provided herewith. In some embodiments, a functional fragment or biologically active fragments of an engineered DNA ligase comprises at least about 90%, 95%, 96%, 97%, 98%, 99%, or more of the activity of the DNA ligase polypeptide from which it was derived (i.e., the parent DNA ligase). In some embodiments, functional fragments or biologically active fragments comprise at least 90%, 91%, 92%, 93%, 94%, 95%, 96%, 97%, 98%, or 99% of the parent sequence of the DNA ligase. In some embodiments, the functional fragment will be truncated by less than 5, less than 10, less than 15, less than 10, less than 25, less than 30, less than 35, less than 40, less than 45, less than 50 amino acids, less than 55 amino acids, less than 60 amino acids, less than 65 amino acids, or less than 70 amino acids.

In some embodiments, a functional fragment of an engineered DNA ligase herein comprises at least 70%, 75%, 80%, 81%, 82%, 83%, 84%, 85%, 90%, 91%, 92%, 93%, 94%, 95%, 96%, 97%, 98%, or 99% of the parent sequence of the engineered DNA ligase. In some embodiments, the functional fragment will be truncated by less than 5, less than 10, less than 15, less than 10, less than 25, less than 30, less than 35, less than 40, less than 45, less than 50, less than 55, less than 60, less than 65, or less than 70 amino acids.

In some embodiments, the functional fragments or biologically active fragments of the engineered DNA ligase polypeptide described herein include at least a mutation or mutation set in the amino acid sequence of the engineered DNA ligase described herein. Accordingly, in some embodiments, the functional fragments or biologically active fragments of the engineered DNA ligase displays the enhanced or improved property associated with the mutation or mutation set in the parent DNA ligase.

Polynucleotides Encoding Engineered Polypeptides, Expression Vectors and Host Cells In another aspect, the present disclosure provides recombinant polynucleotides encoding the engineered DNA ligase described herein. In some embodiments, the recombinant polynucleotides are operably linked to one or more heterologous regulatory sequences that control gene expression to create a recombinant polynucleotide construct capable of expressing the engineered DNA ligase. In some embodiments, expression constructs containing at least one heterologous polynucleotide encoding the engineered DNA ligase polypeptide(s) is introduced into appropriate host cells to express the corresponding DNA ligase polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered DNA ligase of the present disclosure. Thus, the present disclosure provides methods and compositions for the production of each and every possible variation of polynucleotides that could be made that encode the engineered DNA ligase polypeptides described herein by selecting combinations based on the possible codon choices, and all such polynucleotide sequence variations are to be considered specifically disclosed for any polypeptide described herein, including the amino acid sequences presented in the Examples (e.g., in Tables 9.2, 10.2, 11.2, 12.2, 13.2, 14.2, 15.2, 16.2, 17.2, and 18.2) and in the Sequence Listing.

In some embodiments, the codons are preferably optimized for utilization by the chosen host cell for protein production. In some embodiments, preferred codons in bacteria are used for expression in bacteria. In some embodiments, preferred codons in fungal cells are used for expression in fungal cells. In some embodiments, preferred codons in mammalian cells are used for expression in mammalian cells. In some embodiments, preferred codons in insect cells are used for expression in insect cells. In some embodiments, codon optimized polynucleotides encoding an engineered DNA ligase polypeptide described herein contain preferred codons at about 40%, 50%, 60%, 70%, 80%, 90%, or greater than 90% of the codon positions in the full length coding region.

Accordingly, in some embodiments, a recombinant polynucleotide of the present disclosure encodes an engineered DNA ligase polypeptides described herein. In some embodiments, the polynucleotide sequence of the recombinant polynucleotide is codon optimized.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 437 of an even-numbered SEQ ID NO. of SEQ ID NOs: 2 and 40-1184, or to a reference sequence corresponding to an even-numbered SEQ ID NO. of SEQ ID NOs: 2 and 40-1184, wherein the amino acid sequence comprises one or more substitutions relative to a reference sequence corresponding to residues 12 to 437 of SEQ ID NO: 2, 62, 138, 318, 722, or 938, or relative to a reference sequence corresponding to SEQ ID NO: 2, 62, 138, 318, 722, or 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 2, 62, 138, 318, 722, or 938, or to the reference sequence corresponding to SEQ ID NO: 2, 62, 138, 318, 722, or 938, wherein the amino acid sequence comprises one or more substitutions relative to the reference sequence corresponding to residues 12 to 437 of SEQ ID NO: 2, 62, 138, 318, 722, or 938, or relative to the reference sequence corresponding to SEQ ID NO: 2, 62, 138, 318, 722, or 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 2, or to the reference sequence corresponding to SEQ ID NO: 2, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184, wherein the amino acid sequence comprises one or more substitutions relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding the engineered DNA ligase comprising an amino acid sequence comprising at least a substitution at amino acid position 11, 12, 13, 14, 18, 30, 31, 33, 34, 36, 37, 44, 50, 56, 59, 60, 61, 63, 67, 68, 69, 71, 73, 74, 76, 77, 82, 88, 95, 96, 97, 99, 100, 101, 102, 103, 104, 105, 106, 110, 112, 113, 117, 125, 128, 130, 132, 138, 139, 148, 149, 150, 155, 156, 159, 161, 162, 164, 165, 177, 186, 188, 189, 190, 191, 195, 196, 197, 198, 201, 205, 207, 208, 212, 220, 226, 228, 230, 231, 232, 233, 235, 237, 239, 240, 242, 251, 254, 258, 263, 264, 266, 267, 269, 271, 273, 277, 278, 282, 283, 284, 286, 288, 289, 290, 294, 295, 297, 300, 301, 305, 306, 308, 309, 317, 323, 328, 334, 337, 339, 349, 355, 356, 357, 358, 359, 360, 362, 364, 367, 370, 372, 374, 375, 378, 379, 380, 381, 382, 384, 386, 387, 388, 389, 390, 392, 396, 397, 404, 405, 408, 414, 415, 416, 417, 418, 419, 421, 422, 423, or 428, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding the engineered DNA ligase comprising an amino acid sequence comprising at least a substitution at position 63, 242, 283, 286, 317, 414, 418, or 428, or combinations thereof, wherein the amino acid positions are relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding the engineered DNA ligase comprising an amino acid sequence comprising at least a substitution or substitution set at amino acid position(s) 233, 317, 191, 288, 207, 149, 251, 205, 269, 164, 36, 428, 105/132, or 105, wherein the amino acid positions are relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding an engineered DNA ligase comprising an amino acid sequence comprising at least a substitution at an amino acid position set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding an engineered DNA ligase comprising an amino acid sequence comprising at least one substitution set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding an engineered DNA ligase comprising an amino acid sequence comprising at least a substitution or substitution set at the amino acid position(s) set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding an engineered DNA ligase comprising an amino acid sequence comprising at least a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to SEQ ID NO: 2.

In some embodiments, the recombinant polynucleotide comprises a polynucleotide sequence encoding an engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence comprising a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 2, or relative to the reference sequence corresponding to SEQ ID NO: 2.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, 138, 318, 722, or 938, or to the reference sequence corresponding to SEQ ID NO: 62, 138, 318, 722, or 938, wherein the amino acid sequence comprises one or more substitutions relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 40-1184, or to the reference sequence corresponding to an even-numbered SEQ ID NO. of SEQ ID NOs: 40-1184, wherein the amino acid sequence comprises one or more substitutions relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence comprising at least a substitution at amino acid position 11, 12, 13, 14, 18, 30, 31, 33, 34, 36, 37, 44, 50, 56, 59, 60, 61, 63, 67, 68, 69, 71, 73, 74, 76, 77, 82, 88, 95, 96, 97, 99, 100, 101, 102, 103, 104, 105, 106, 110, 112, 113, 117, 125, 128, 130, 132, 138, 139, 148, 149, 150, 155, 156, 159, 161, 162, 164, 165, 177, 186, 188, 189, 190, 191, 195, 196, 197, 198, 201, 205, 207, 208, 212, 220, 226, 228, 230, 231, 232, 233, 235, 237, 239, 240, 242, 251, 254, 258, 263, 264, 266, 267, 269, 271, 273, 277, 278, 282, 283, 284, 286, 288, 289, 290, 294, 295, 297, 300, 301, 305, 306, 308, 309, 317, 323, 328, 334, 337, 339, 349, 355, 356, 357, 358, 359, 360, 362, 364, 367, 370, 372, 374, 375, 378, 379, 380, 381, 382, 384, 386, 387, 388, 389, 390, 392, 396, 397, 404, 405, 408, 414, 415, 416, 417, 418, 419, 421, 422, 423, or 428, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence comprising at least a substitution at amino acid position 63, 242, 283, 286, 317, 414, 418, or 428, or combinations thereof, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 62, or to the reference sequence corresponding to SEQ ID NO: 62, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the recombinant polynucleotide comprises a polynucleotide sequence encoding the engineered DNA ligase comprising an amino acid sequence comprising at least a substitution or substitution set at amino acid position(s) 196, 242, 337, 33, 277, 30, 359, 283, 415, 387, 379, 205, 186, 389, 102, 164, 301, 375, 267, 380, 254, 317, 77/139/317/417, 105/317/417, 317/349/362/386, 105/317, 139/317/362, 233/317/405, 139/317, 162, 286, 414, 417, 226, 61, 105, 230, 418, 370, 297, 237, 428, 362, 233, 235, 148, 100, 97, 382, or 358, wherein the amino acid positions are relative to the reference sequence corresponding to residues 12 to 437 of SEQ ID NO: 62, or relative to the reference sequence corresponding to SEQ ID NO: 62.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 68-312, or to the reference sequence corresponding to an even-numbered SEQ ID NO. of SEQ ID NOs: 68-312, wherein the amino acid sequence comprises one or more substitutions relative to the reference sequence corresponding to residues 12 to 437 of SEQ ID NO: 62, or relative to the reference sequence corresponding to SEQ ID NO: 62.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 138, or to the reference sequence corresponding to SEQ ID NO: 138, wherein the amino acid sequence comprises one or more substitutions relative to the reference sequence corresponding to residues 12 to 437 of SEQ ID NO: 138, or relative to the reference sequence corresponding to SEQ ID NO: 138.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 314-458, or to the reference sequence corresponding to an even-numbered SEQ ID NO. of SEQ ID NOs: 314-458, wherein the amino acid sequence comprises one or more substitutions relative to the reference sequence corresponding to residues 12 to 437 of SEQ ID NO: 138, or relative to the reference sequence corresponding to SEQ ID NO: 138.

In some embodiments, the recombinant polynucleotide comprises a polynucleotide sequence encoding the engineered DNA ligase comprising an amino acid sequence comprising at least a substitution or substitution set at amino acid position(s) 242/283/286/359/418, 283/286, 283/286/418, 186/242/283/286/418, 205/286/359, 283, 242/286/418, 186/205/242, 283/286/359, 277/286/359/418, 186/205/283/286/359, 242/277/418, 242/283/286/418, 112/196/389, 286, 283/286/359/418, 242/359/418, 186/283, 186/359/418, 205/242/418, 186/205/242/283/286/359/418, 205/359/418, 186/205/283/286/418, 186/283/359, 186/242, 186/242/359, 283/359/418, 277/418, 186/188/283, 186/286/418, 186/242/286/359/418, 418, 186/242/283/286/359/418, 186/277/359/418, 242/283/286, 205/418, 30/297, 205/242/286/359/418, 186/205/359/418, 359/418, 186, 230, 33/297, 186/205, 186/283/359/418, 186/418, 205/242/283/359/418, 33/375/389, 33/230, 196/242/283/286/359/418, 186/242/283/359/418, 186/359, 33/196, 186/277/418, 242, 33/196/297/301, 205/237/242/283/286/359, 186/205/283/359/418, 33/389, or 186/196/242/283/286/359/418, wherein the amino acid positions are relative to the reference sequence corresponding to residues 12 to 437 of SEQ ID NO: 138, or relative to the reference sequence corresponding to SEQ ID NO: 138.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 318, or to the reference sequence corresponding to SEQ ID NO: 318, wherein the amino acid sequence comprises one or more substitutions relative to the reference sequence corresponding to residues 12 to 437 of SEQ ID NO: 318, or relative to the reference sequence corresponding to SEQ ID NO: 318.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 460-936, or to the reference sequence corresponding to an even-numbered SEQ ID NO. of SEQ ID NOs: 460-936, wherein the amino acid sequence comprises one or more substitutions relative to the reference sequence corresponding to residues 12 to 437 of SEQ ID NO: 318, or relative to the reference sequence corresponding to SEQ ID NO: 318.

In some embodiments, the recombinant polynucleotide comprises a polynucleotide sequence encoding the engineered DNA ligase comprising an amino acid sequence comprising at least a substitution or substitution set at amino acid position(s) 363, 63, 389, 381, 197, 359, 102, 165, 388, 414, 337, 164, 416, 101, 415, 423, 364, 73, 50, 71, 388/419, 357, 396, 68, 76, 14, 271, 360, 266, 208, 74, 263, 264, 13, 378, 372, 300, 294, 290, 397, 95, 258, 161, 212, 198, 138, 18, 404, 273, 117, 240, 69, 278, 289, 82, 328, 61/186/417, 186/370/417, 267, 61/370, 186/267/370/417, 61/186, 370/417, 417, 61/370/382, 61/186/267/370/417, 61, 267/370/417, 267/370, 61/417, 61/186/237/267/370, 61/237/370/417, 370, 186/370, 61/186/267/417, 61/186/370/382, 370/382/417, 61/186/370, 237/267/370/417, 61/186/382, 61/267, 61/267/417, 61/237/267/382, 186/370/382, 237/267/370, 61/186/267/370, 186/237/267/370, 61/186/267, 61/186/237, 186, 186/267, 237/370/417, 242/414, 162/414, 267/414, 105/414, 162/242/414, 97/162/414, 105/162/267/414, 356, 392, 106, 308, 306, 96, 282, 113, 309, 110, 37, 201, 284, 374, 295, 88, 44, 12, or 390, wherein the amino acid positions are relative to the reference sequence corresponding to residues 12 to 437 of SEQ ID NO: 318, or relative to the reference sequence corresponding to SEQ ID NO: 318.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 722, or to the reference sequence corresponding to SEQ ID NO: 722, wherein the amino acid sequence comprises one or more substitutions relative to the reference sequence corresponding to residues 12 to 437 of SEQ ID NO: 722, or relative to the reference sequence corresponding to SEQ ID NO: 722.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 938-1098, or to the reference sequence corresponding to an even-numbered SEQ ID NO. of SEQ ID NOs: 938-1098, wherein the amino acid sequence comprises one or more substitutions relative to the reference sequence corresponding to residues 12 to 437 of SEQ ID NO: 722, or relative to the reference sequence corresponding to SEQ ID NO: 722.

In some embodiments, the recombinant polynucleotide comprises a polynucleotide sequence encoding the engineered DNA ligase comprising an amino acid sequence comprising at least a substitution or substitution set at amino acid position(s) 63, 63/96/370, 389, 13/267/363/389, 13/186/389, 50/267/363/370/389, 363/370, 96/370, 61/63/212, 11/305, 11, 242/283/286/317/414/418, 323, 334, 339, 356, 384, 408, 67, 392, 104, 355, 159, 155, 367, 31, 231, 36, 150, 239, 103, 125, 228, 37, 189, 177, 422, 128, 220, 130, 56, 190, 156, 232, 423, 34, 99, 59, 60, 421, or 195, wherein the amino acid positions are relative to the reference sequence corresponding to residues 12 to 437 of SEQ ID NO: 722, or relative to the reference sequence corresponding to SEQ ID NO: 722.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of SEQ ID NO: 938, or to the reference sequence corresponding to SEQ ID NO: 938, wherein the amino acid sequence comprises one or more substitutions relative to the reference sequence corresponding to residues 12 to 437 of SEQ ID NO: 938, or relative to the reference sequence corresponding to SEQ ID NO: 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 437 of an even-numbered SEQ ID NO. of SEQ ID NOs: 1100-1184, or to the reference sequence corresponding to an even-numbered SEQ ID NO. of SEQ ID NOs: 1100-1184, wherein the amino acid sequence comprises one or more substitutions relative to the reference sequence corresponding to residues 12 to 437 of SEQ ID NO: 938, or relative to the reference sequence corresponding to SEQ ID NO: 938.

In some embodiments, the recombinant polynucleotide comprises a polynucleotide sequence encoding the engineered DNA ligase comprising an amino acid sequence comprising at least a substitution or substitution set at amino acid position(s) 308/357/390, 74/76/201/308/357, 61/74/76/186/201/308/309/357/390, 14/201/240/289/357, 308/415, 76/357/396, 263/308/396, 61/76/96/240/308/309, 14/306/415, 14/73/106/415, 12/14/258/263/289/308/309/396, 74/76/117/309/357, 14/258/263/357/396, 14/96/106/306, 14/106, 12/14/308/309, 14/357/390, 14/117/258/309/357, 390, 240/273/357/390, 61/76/186/201/308/309, 14/396, 309, 14, 106/306/308, 14/240/306/308, 12/14/186/357, 309/390, 14/306, 14/76/308, 117/208/258/263/289/308/309, 14/73/106, 76/208/263, 357, 14/308, 263, 76, 14/300/308/415, 240, 33/357/390, 14/76/273, or 74, wherein the amino acid positions are relative to the reference sequence corresponding to residues 12 to 437 of SEQ ID NO: 938, or relative to the reference sequence corresponding to SEQ ID NO: 938.

In some embodiments, the recombinant polynucleotide comprises a polynucleotide sequence encoding the engineered DNA ligase comprising an amino acid sequence comprising at least a substitution at an amino acid position set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence comprising at least one substitution set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence comprising at least a substitution or substitution set at amino acid position(s) set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence comprising at least a substitution or substitution set of an engineered DNA ligase variant set forth in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence comprising at least a substitution or substitution set provided in Tables 9.2, 10.2, 11.2, 12.2, 13.2, 14.2, 15.2, 16.2, 17.2, and 18.2, wherein the amino acid positions are relative to the reference sequence corresponding to residues 12 to 437 of SEQ ID NO: 62, 138, 318, 722, or 938, or relative to the reference sequence corresponding to SEQ ID NO: 62, 138, 318, 722, or 938.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a sequence corresponding to residues 12 to 437 of an engineered DNA ligase variant set forth in Tables 9.2, 10.2, 11.2, 12.2, 13.2, 14.2, 15.2, 16.2, 17.2, and 18.2, or to a sequence corresponding to an engineered DNA ligase variant set forth in Tables 9.2, 10.2, 11.2, 12.2, 13.2, 14.2, 15.2, 16.2, 17.2, and 18.2.

In some embodiments, the recombinant polynucleotide comprises a polynucleotide sequence encoding the engineered DNA ligase comprising an amino acid sequence comprising residues 12 to 437 of an even numbered SEQ ID NO. of SEQ ID NOs: 40-1184, or an amino acid sequence comprising an even numbered SEQ ID NO. of SEQ ID NOs: 40-1184, optionally wherein the amino acid sequence has 1, 2, 3, 4, 5, 6, 7, 8, 9, or up to 10 substitutions.

In some embodiments, the recombinant polynucleotide comprises a polynucleotide sequence encoding the engineered DNA ligase comprising residues 12 to 437 of SEQ ID NO: 62, 138, 318, 722, 938 or 1108, or an amino acid sequence comprising SEQ ID NO: 62, 138, 318, 722, 938 or 1108, optionally wherein the amino acid sequence has 1, 2, 3, 4, 5, 6, 7, 8, 9, or up to 10 substitutions in the amino acid sequence.

In some embodiments, the recombinant polynucleotide comprises a polynucleotide sequence having at least 70%, 75%, 75%, 80%, 81%, 82%, 83%, 84%, 85%, 90%, 91%, 92%, 93%, 94%, 95%, 96%, 97%, 98%, 99%, or more sequence identity to a reference polynucleotide sequence corresponding to nucleotide residues 34 to 1311 of SEQ ID NO: 1, 61, 137, 317, 721, or 937, or to a reference polynucleotide sequence corresponding to SEQ ID NO: 1, 61, 137, 317, 721, or 937, wherein the recombinant polynucleotide encodes an engineered DNA ligase.

In some embodiments, the recombinant polynucleotide comprises a polynucleotide sequence having at least 70%, 75%, 80%, 81%, 82%, 83%, 84%, 85%, 90%, 91%, 92%, 93%, 94%, 95%, 96%, 97%, 98%, 99%, or more sequence identity to a reference polynucleotide sequence corresponding to nucleotide residues 34 to 1311 of an odd numbered SEQ ID NO. of SEQ ID NOs: 39-1183, or to a reference polynucleotide sequence corresponding to an odd numbered SEQ ID NO. of SEQ ID NOs: 39-1183, wherein the recombinant polynucleotide encodes an engineered DNA ligase.

In some embodiments, the recombinant polynucleotide comprises a polynucleotide sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to the sequence corresponding to nucleotide residues 34 to 1311 of SEQ ID NO: 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447,449, 451, 453, 455, 457, 459, 461, 463, 465, 467, 469, 471,473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, or 1183, wherein the recombinant polynucleotide encodes a DNA ligase.

In some embodiments, the recombinant polynucleotide comprises a polynucleotide sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to the sequence corresponding to SEQ ID NO: 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401,403, 405, 407, 409, 411, 413, 415, 417, 419, 421, 423, 425, 427, 429, 431, 433, 435, 437, 439, 441,443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, or 1183, wherein the recombinant polynucleotide encodes a DNA ligase.

In some embodiments, as discussed above, the recombinant polynucleotide comprises a polynucleotide sequence is codon-optimized for expression of the encoded engineered DNA ligase. In some embodiments, the polynucleotide sequence is codon optimized for expression in prokaryotic cells. In some embodiments, the polynucleotide sequence is codon optimized for expression in eukaryotic cells. In some embodiments, the polynucleotide sequence is codon optimized for expression in bacterial cells.

In some embodiments, the recombinant polynucleotide comprises a polynucleotide sequence comprising nucleotide residues 34 to 1311 of an odd numbered SEQ ID NO. of SEQ ID NOs: 39-1183, or a polynucleotide sequence comprising an odd numbered SEQ ID NO. of SEQ ID NOs: 39-1183.

In some embodiments, the recombinant polynucleotide comprises a polynucleotide sequence comprising nucleotide residues 34 to 1311 of SEQ ID NO: 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425,427, 429, 431, 433, 435, 437, 439, 441,443, 445, 447, 449, 451, 453, 455, 457, 459, 461,463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, or 1183.

In some embodiments, the recombinant polynucleotide comprises a polynucleotide sequence comprising SEQ ID NO: 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447,449, 451, 453, 455, 457, 459, 461, 463, 465, 467, 469, 471,473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, or 1183.

In some embodiments, the recombinant polynucleotide comprises a polynucleotide sequence comprising nucleotide residues 34 to 1311 of SEQ ID NO: 1, 61, 137, 317, 721, 937 or 1107, or a polynucleotide sequence comprising SEQ ID NO: 1, 61, 137, 317, 721, 937 or 1107.

In some embodiments, the recombinant polynucleotide hybridizes under highly stringent conditions to a reference polynucleotide sequence described herein encoding an engineered DNA ligase, e.g., a recombinant polynucleotide provided in Tables 9.2, 10.2, 11.2, 12.2, 13.2, 14.2, 15.2, 16.2, 17.2, and 18.2, or a reverse complement thereof. In some embodiments, the reference polynucleotide sequence corresponds to nucleotide residues 34 to 1311 of SEQ ID NO: 1, 61, 137, 317, 721, or 937, or the sequence corresponding to SEQ ID NO: 1, 61, 137, 317, 721, or 937, or a reverse complement thereof, or a polynucleotide sequence encoding any of the other engineered DNA ligases provided herein. In some embodiments, the recombinant polynucleotide encodes a DNA ligase and hybridizes under highly stringent conditions to a reverse complement of a reference polynucleotide sequence corresponding to nucleotide residues 34 to 1311 of an odd numbered SEQ ID NO. of SEQ ID NOs: 39-1183, or to a reference polynucleotide sequence corresponding to an odd numbered SEQ ID NO. of SEQ ID NOs: 39-1183.

In some embodiments, the recombinant polynucleotide hybridizes under highly stringent conditions to a reverse complement of a reference polynucleotide sequence encoding an engineered DNA ligase, wherein the engineered DNA ligase comprises an amino acid sequence having one or more amino acid differences as compared to SEQ ID NO: 2, 62, 138, 318, 722, or 938, at residue positions selected from any positions as set forth in Tables 9.2, 10.2, 11.2, 12.2, 13.2, 14.2, 15.2, 16.2, 17.2, and 18.2. In some embodiments, the polynucleotide that hybridizes under highly stringent conditions comprises a polynucleotide sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference polynucleotide sequence corresponding to nucleotide residues 39-1183 of SEQ ID NO: 1, 61, 137, 317, 721, or 937, or to a reference polynucleotide sequence corresponding to SEQ ID NO: 1, 61, 137, 317, 721, or 937. In some additional embodiments, the polynucleotide that hybridizes under highly stringent conditions comprises a polynucleotide sequence having at least 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference polynucleotide sequence corresponding to nucleotide residues 39-1183 of a polynucleotide sequence set forth in Tables 9.2, 10.2, 11.2, 12.2, 13.2, 14.2, 15.2, 16.2, 17.2, and 18.2, or a polynucleotide sequence set forth in Tables 9.2, 10.2, 11.2, 12.2, 13.2, 14.2, 15.2, 16.2, 17.2, and 18.2.

In some embodiments, the recombinant polynucleotide comprises a polynucleotide sequence encoding the engineered DNA ligase comprising an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to (a) a sequence corresponding to residues 12 to 437 of SEQ ID NO: 2, a sequence corresponding to residues 12 to 613 of SEQ ID NO: 4, residues 12 to 614 of SEQ ID NO: 6, residues 12 to 610 of SEQ ID NO: 8, residues 12 to 606 of SEQ ID NO: 10, residues 12 to 615 of SEQ ID NO: 12, residues 12 to 594 of SEQ ID NO: 14, residues 12 to 620 of SEQ ID NO: 16, residues 12 to 608 of SEQ ID NO: 18, residues 12 to 611 of SEQ ID NO: 20, residues 12 to 614 of SEQ ID NO: 22, residues 12 to 611 of SEQ ID NO: 24, residues 12 to 609 of SEQ ID NO: 26, residues 12 to 422 of SEQ ID NO: 28, residues 12 to 518 of SEQ ID NO: 30, residues 12 to 438 of SEQ ID NO: 32, residues 12 to 381 of SEQ ID NO: 34, residues 12 to 424 of SEQ ID NO: 36, or residues 12 to 390 of SEQ ID NO: 38; or (b) a sequence corresponding to SEQ ID NO: 2, 4, 6, 8, 10, 12, 14, 16, 18, 20, 22, 24, 26, 28, 30, 32, 34, 36, or 38.

In some embodiments, the recombinant polynucleotide comprises a polynucleotide sequence encoding the engineered DNA ligase comprising an amino acid sequence (a) comprising residues 12 to 437 of SEQ ID NO: 2, residues 12 to 613 of SEQ ID NO: 4, residues 12 to 614 of SEQ ID NO: 6, residues 12 to 610 of SEQ ID NO: 8, residues 12 to 606 of SEQ ID NO: 10, residues 12 to 615 of SEQ ID NO: 12, residues 12 to 594 of SEQ ID NO: 14, residues 12 to 620 of SEQ ID NO: 16, residues 12 to 608 of SEQ ID NO: 18, residues 12 to 611 of SEQ ID NO: 20, residues 12 to 614 of SEQ ID NO: 22, residues 12 to 611 of SEQ ID NO: 24, residues 12 to 609 of SEQ ID NO: 26, residues 12 to 422 of SEQ ID NO: 28, residues 12 to 518 of SEQ ID NO: 30, residues 12 to 438 of SEQ ID NO: 32, residues 12 to 381 of SEQ ID NO: 34, residues 12 to 424 of SEQ ID NO: 36, or residues 12 to 390 of SEQ ID NO: 38; or (b) comprising SEQ ID NO: 2, 4, 6, 8, 10, 12, 14, 16, 18, 20, 22, 24, 26, 28, 30, 32, 34, 36, or 38.

In some embodiments, the recombinant polynucleotide comprises a polynucleotide sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to (a) a polynucleotide sequence corresponding to residues 34 to 1311 of SEQ ID NO: 1, residues 34 to 1839 of SEQ ID NO: 3, residues 34 to 1842 of SEQ ID NO: 5, residues 34 to 1830 of SEQ ID NO: 7, residues 34 to 1818 of SEQ ID NO: 9, residues 34 to 1845 of SEQ ID NO: 11, residues 34 to 1782 of SEQ ID NO: 13, residues 34 to 1860 of SEQ ID NO: 15, residues 34 to 1824 of SEQ ID NO: 17, residues 34 to 1833 of SEQ ID NO: 19, residues 34 to 1842 of SEQ ID NO: 21, residues 34 to 1833 of SEQ ID NO: 23, residues 34 to 1827 of SEQ ID NO: 25, residues 34 to 1266 of SEQ ID NO: 27, residues 34 to 1554 of SEQ ID NO: 29, residues 34 to 1314 of SEQ ID NO: 31, residues 34 to 1143 of SEQ ID NO: 33, residues 34 to 1272 of SEQ ID NO: 35, or residues 34 to 1170 of SEQ ID NO: 37; or (b) a polynucleotide sequence corresponding to SEQ ID NO: 1, 3, 5, 7, 9, 11, 13, 15, 17, 19, 21, 23, 25, 27, 29, 31, 33, 35, or 37; wherein the polynucleotide sequence encodes a DNA ligase.

In some embodiments, the recombinant polynucleotide comprises a polynucleotide sequence (a) comprising residues 34 to 1311 of SEQ ID NO: 1, residues 34 to 1839 of SEQ ID NO: 3, residues 34 to 1842 of SEQ ID NO: 5, residues 34 to 1830 of SEQ ID NO: 7, residues 34 to 1818 of SEQ ID NO: 9, residues 34 to 1845 of SEQ ID NO: 11, residues 34 to 1782 of SEQ ID NO: 13, residues 34 to 1860 of SEQ ID NO: 15, residues 34 to 1824 of SEQ ID NO: 17, residues 34 to 1833 of SEQ ID NO: 19, residues 34 to 1842 of SEQ ID NO: 21, residues 34 to 1833 of SEQ ID NO: 23, residues 34 to 1827 of SEQ ID NO: 25, residues 34 to 1266 of SEQ ID NO: 27, residues 34 to 1554 of SEQ ID NO: 29, residues 34 to 1314 of SEQ ID NO: 31, residues 34 to 1143 of SEQ ID NO: 33, residues 34 to 1272 of SEQ ID NO: 35, or residues 34 to 1170 of SEQ ID NO: 37; or (b) comprising SEQ ID NO: 1, 3, 5, 7, 9, 11, 13, 15, 17, 19, 21, 23, 25, 27, 29, 31, 33, 35, or 37.

In some embodiments, a recombinant polynucleotide encoding any of the DNA ligases herein is manipulated in a variety of ways to facilitate expression of the DNA ligase polypeptide. In some embodiments, the recombinant polynucleotide encoding the DNA ligase comprises expression vectors where one or more control sequences is present to regulate the expression of the DNA ligase polynucleotides and/or polypeptides. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators.

In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (see, e.g., Villa-Kamaroff et al., Proc. Natl Acad. Sci. USA, 1978, 75:3727-3731), as well as the tac promoter (see, e.g., DeBoer et al., Proc. Natl Acad. Sci. USA, 1983, 80:21-25). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (see, e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (see, e.g., Romanos et al., Yeast, 1992, 8:423-488). Exemplary promoters for use in insect cells include, but are not limited to, polyhedrin, p10, ELT, OpIE2, and hr5/ie1 promoters. Exemplary promoters for use in mammalian cells include, but are not limited to, those from cytomegalovirus (CMV), chicken β-actin promoter fused with the CMV enhancer, Simian vacuolating virus 40 (SV40), from *Homo sapiens* phosphoglycerate kinase, beta actin, elongation factor-1a or glyceraldehyde-3-phosphate dehydrogenase, and from Gallus β-actin.

In some embodiments, the control sequence is a suitable transcription terminator sequence (i.e., a sequence recognized by a host cell to terminate transcription). In some embodiments, the terminator sequence is operably linked to the 3' terminus of the nucleic acid sequence encoding the DNA ligase polypeptide. Any suitable terminator which is functional in the host cell of choice finds use in the present invention. For bacterial expression, the transcription terminators can be a Rho-dependent terminators that rely on a Rho transcription factor, or a Rho-independent, or intrinsic terminators, which do not require a transcription factor. Exemplary bacterial transcription terminators are described in Peters et al., J Mol Biol., 2011, 412(5):793-813. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (see, e.g., Romanos et al., supra). Exemplary terminators for insect cells and mammalian cells include, but are not limited to, those from cytomegalovirus (CMV), Simian virus 40 (SV40), from *Homo sapiens* growth hormone hGH, from bovine growth hormone BGH, and from human or rabbit beta globulin.

In some embodiments, the control sequence is a suitable leader sequence, a non-translated region of an mRNA that is important for translation by the host cell. In some embodiments, the leader sequence is operably linked to the 5' terminus of the nucleic acid sequence encoding the DNA ligase polypeptide. Any suitable leader sequence that is functional in the host cell of choice find use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP). Suitable leaders for mammalian host cells include but are not limited to the 5'-UTR element present in orthopoxvirus mRNA.

In some embodiments, the control sequence is a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (see, e.g., Guo and Sherman, Mol. Cell. Biol., 1995, 15:5983-5990). Useful polyadenylation and 3' UTR sequences for insect and mammalian host cells include, but are not limited to, OpIE2 polyA sequence, *D. melanogaster* metallothionein (Mt) polyA signal sequence, *D. melanogaster* alcohol dehydrogenase (adh), SV40 polyA signal sequence, and the 3'-UTRs of α- and β-globin mRNAs harboring sequence elements that increase the stability and translation of mRNA.

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (see, e.g., Simonen and Palva, Microbiol. Rev., 1993, 57:109-137). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase. Useful signal peptides for insect and mammalian host cells include but are not limited to, those from the genes for immunoglobulin gamma (IgG) and the signal peptide in a human secreted protein, such as human beta-galactosidase polypeptide.

In some embodiments, the control sequence is a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (see, e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present disclosure provides a recombinant expression vector comprising a polynucleotide encoding an engineered DNA ligase polypeptide, and one or more expression regulating regions such as a promoter and a terminator, a replication origin, etc., depending on the type of hosts into which they are to be introduced. In some embodiments, the various nucleic acid and control sequences described herein are joined together (i.e., operably linked) to produce recombinant expression vectors. Alternatively, in some embodiments, the nucleic acid sequence of the present disclosure is expressed by inserting the nucleic acid sequence or a nucleic acid construct comprising the sequence into an appropriate vector for expression.

The recombinant expression vector may be any suitable vector (e.g., a plasmid or virus), that can be conveniently subjected to recombinant DNA procedures and bring about the expression of the DNA ligase polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiment, the recombinant polynucleotides may be provided on a non-replicating expression vector or plasmid. In some embodiments, the non-replicating expression vector or plasmid can be based on viral vectors defective in replication (see, e.g., Travieso et al., npj Vaccines, 2022, Vol. 7, Article 75).

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. orzyae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. orzyae*), sC (sulfate adenyltransferase), and trpC (anthranilate synthase), as well as equivalents thereof.

In another aspect, the present disclosure provides a host cell comprising a polynucleotide encoding at least one engineered DNA ligase polypeptide of the present disclosure, the polynucleotide(s) being operably linked to one or more control sequences for expression of the engineered DNA ligase enzyme(s) in the host cell. In some embodiments, the host cell comprises an expression vector comprising a polynucleotide encoding an engineered DNA ligase polypeptide described herein, where the polynucleotide is operably linked to one or more control sequences. Host cells suitable for use in expressing the polypeptides encoded by the expression vectors of the present invention are known in the art and include but are not limited to, bacterial cells, such as *E. coli, B. subtilis, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21).

In another aspect, the present disclosure provides a method of producing the engineered DNA ligase polypeptides, where the method comprises culturing a host cell capable of expressing a polynucleotide encoding the engineered DNA ligase polypeptide under conditions suitable for expression of the polypeptide such that the engineered DNA ligase is produced. In some embodiments, the method further comprises the step(s) of isolating and/or purifying the DNA ligase polypeptides, as described herein.

Appropriate culture media and growth conditions for host cells are known in the art. It is contemplated that any suitable method for introducing polynucleotides for expression of the DNA ligase polypeptides into cells will find use in the present invention. Suitable techniques include, but are not limited to electroporation, biolistic particle bombardment, liposome mediated transfection, calcium chloride transfection, and protoplast fusion.

In some embodiments, recombinant polypeptides (e.g., DNA ligase variants) can be produced using any suitable methods known the art. For example, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased stability, increased substrate range, increased inhibitor resistance/tolerance, increased solubility, pH stability, etc.).

In some embodiments, the engineered DNA ligase polypeptides with the properties disclosed herein can be obtained by subjecting the polynucleotide encoding the naturally occurring or engineered DNA ligase polypeptide to a suitable mutagenesis and/or directed evolution methods known in the art, for example, as described herein. An exemplary directed evolution technique is mutagenesis and/or DNA shuffling (see, e.g., Stemmer, Proc. Natl. Acad. Sci. USA, 1994, 91:10747-10751; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (see, e.g., Zhao et al., Nat. Biotechnol., 1998, 16:258-261), mutagenic PCR (see, e.g., Caldwell et al., PCR Methods Appl., 1994, 3:S136-S140), and cassette mutagenesis (see, e.g., Black et al., Proc. Natl. Acad. Sci. USA, 1996, 93:3525-3529).

Mutagenesis and directed evolution methods can be applied to DNA ligase-encoding polynucleotides to generate variant libraries that can be expressed, screened, and assayed. Any suitable mutagenesis and directed evolution methods find use in the present disclosure and are known in the art (see, e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,665,694, 9,684,771, and all related PCT and non-US counterparts; Ling et al., Anal. Biochem., 1997, 254(2):157-78; Dale et al., Meth. Mol. Biol., 1996, 57:369-74; Smith, Ann. Rev. Genet., 1985, 19:423-462; Botstein et al., Science, 1985, 229:1193-1201; Carter, Biochem. J., 1986, 237:1-7; Kramer et al., Cell, 1984, 38:879-887; Wells et al., Gene, 1985, 34:315-323; Minshull et al., Cuff. Op. Chem. Biol., 1999, 3:284-290; Christians et al., Nat. Biotechnol., 1999, 17:259-264; Crameri et al., Nature, 1998, 391:288-291; Crameri, et al., Nat. Biotechnol., 1997, 15:436-438; Zhang et al., Proc. Nat. Acad. Sci. U.S.A., 1997, 94:4504-4509; Crameri et al., Nat. Biotechnol., 1996, 14:315-319; Stemmer, Nature, 1994, 366:389-391; Stemmer, Proc. Nat. Acad. Sci. USA, 1994, 91:10747-10751; EP 3 049 973; WO 95/22625; WO 97/0078; WO 97/35966; WO 98/27230; WO 00/42651; WO 01/75767; WO 2009/152336; and WO 2015/048573, all of which are incorporated herein by reference).

In some embodiments, the clones obtained following mutagenesis treatment are screened by subjecting the enzyme preparations to a defined treatment conditions or assay conditions (e.g., temperature, pH condition, type of ligase substrate, input substrate concentration, etc.) and measuring DNA ligase activity after the treatments or other suitable assay conditions. Clones containing a polynucleotide encoding the polypeptide of interest are then isolated from the gene, sequenced to identify the nucleotide sequence changes (if any), and used to express the enzyme in a host cell. Measuring enzyme activity from the expression libraries can be performed using any suitable method known in the art and as described in the Examples.

For engineered polypeptides of known sequence, the polynucleotides encoding the polypeptide can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence (see, e.g., Hughes et al., Cold Spring Harb Perspect Biol. 2017 January; 9(1):a023812). For example, polynucleotides and oligonucleotides disclosed herein can be prepared by chemical synthesis using the phosphoramidite method (see, e.g., Beaucage et al., Tet. Lett., 1981, 22:1859-69; and Matthes et al., EMBO J., 1984, 3:801-05), as it is typically practiced in automated synthetic methods.

In some embodiments, a method for preparing the engineered DNA ligase polypeptide can comprise: (a) synthesizing a polynucleotide encoding a polypeptide comprising an amino acid sequence selected from the amino acid sequence of any variant as described herein, and (b) expressing the DNA ligase polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions are conservative or non-conservative substitutions.

In some embodiments, any of the engineered DNA ligase polypeptides expressed in a host cell are recovered and/or purified from the cells and/or the culture medium using any one or more of the known techniques for protein purification, including, among others, lysozyme treatment, sonication, filtration, salting-out, ultra-centrifugation, and chromatography.

Chromatographic techniques for isolation/purification of the DNA ligase polypeptides include, among others, reverse phase chromatography, high-performance liquid chromatography, ion-exchange chromatography, hydrophobic-interaction chromatography, size-exclusion chromatography, gel electrophoresis, and affinity chromatography. Conditions for purifying the DNA ligase depends, in part, on factors such as net charge, hydrophobicity, hydrophilicity, molecular weight, molecular shape, etc., and will be apparent to those having skill in the art. In some embodiments, affinity techniques may be used to isolate the DNA ligase. For affinity chromatography purification, an antibody that specifically binds DNA ligase polypeptide may be used. In some embodiments, an affinity tag, e.g., His-tag, can be introduced into the DNA ligase polypeptide for purposes of isolation/purification.

Compositions

In a further aspect, the present disclosure provides a composition of the DNA ligases disclosed herein. In some embodiments, the composition comprises at least one engineered DNA ligase polypeptide described herein. In some embodiments, the engineered DNA ligase polypeptide in the compositions is isolated or purified. In some embodiments, the DNA ligase is combined with other components and compounds to provide compositions and formulations comprising the engineered DNA ligase polypeptide as appropriate for different applications and uses.

In some embodiments, the composition comprises at least one engineered DNA ligase described herein, e.g., an engineered DNA ligase provided in Tables 9.2, 10.2, 11.2, 12.2, 13.2, 14.2, 15.2, 16.2, 17.2, and 18.2. the composition comprises an engineered DNA ligase comprising an amino acid sequence comprising residues 12 to 437 of an even-numbered SEQ ID NO. of SEQ ID NOs: 40-1184, or an amino acid sequence comprising an even-numbered SEQ ID NO. of SEQ ID NOs: 40-1184.

In some embodiments, the composition comprises a DNA ligase provided in Table 8.1. In some embodiments, the composition comprises a DNA ligase comprising an amino acid sequence (a) comprising residues 12 to 437 of SEQ ID NO: 2, residues 12 to 613 of SEQ ID NO: 4, residues 12 to 614 of SEQ ID NO: 6, residues 12 to 610 of SEQ ID NO: 8, residues 12 to 606 of SEQ ID NO: 10, residues 12 to 615 of SEQ ID NO: 12, residues 12 to 594 of SEQ ID NO: 14, residues 12 to 620 of SEQ ID NO: 16, residues 12 to 608 of SEQ ID NO: 18, residues 12 to 611 of SEQ ID NO: 20, residues 12 to 614 of SEQ ID NO: 22, residues 12 to 611 of SEQ ID NO: 24, residues 12 to 609 of SEQ ID NO: 26, residues 12 to 422 of SEQ ID NO: 28, residues 12 to 518 of SEQ ID NO: 30, residues 12 to 438 of SEQ ID NO: 32, residues 12 to 381 of SEQ ID NO: 34, residues 12 to 424 of SEQ ID NO: 36, or residues 12 to 390 of SEQ ID NO: 38; or (b) comprising SEQ ID NO: 2, 4, 6, 8, 10, 12, 14, 16, 18, 20, 22, 24, 26, 28, 30, 32, 34, 36, or 38.

In some embodiments, the composition further comprises one or more of a buffer, a nucleotide substrate (e.g., ATP), and/or at least one or more DNA ligase substrates, such as synthetic oligonucleotides or recombinant polynucleotides. In some embodiments, the DNA ligase substrate comprises an DNA adapter or linker. In some embodiments, the composition further comprises one or more of a divalent cation (e.g., $Mg^{+2}$ or $Mn^{+2}$), reducing agent (e.g., DTT), and/or salts (e.g., KCl and/or NaCl).

In some embodiments, the composition further comprises an additive or ligation enhancing agent, including, among others, one or more of DMSO, betaine, polyethylene glycol (e.g., PEG 6000, PEG 8000, etc.), bovine serum albumin, Ficoll, and dextran (e.g., Dextran 6000). In some embodiments, the composition comprises 1% to 40% v/v of DMSO. In some embodiments, the composition comprises 0.1 M to 3 M betaine. In some embodiments, the composition comprises 0.5% to 20% w/v of PEG (e.g., PEG6000 or PEG8000).

In some embodiments, the composition further comprises a second nucleic acid modifying enzyme, including, among others, a DNA polymerase (e.g., thermal DNA polymerase, isothermal polymerase, reverse transcriptase, RNA polymerase, etc.), restriction enzyme, polynucleotide kinase, or a terminal transferase.

In some embodiments, an engineered DNA ligase described herein is provided in solution, as a lyophilizate, or is immobilized on a substrate. In some embodiments, the substrate is a solid substrate, porous substrate, membrane, or particles. The enzyme can be entrapped in matrixes or membranes. In some embodiments, matrices include polymeric materials such as calcium-alginate, agar, k-carrageenin, polyacrylamide, agarose or derivatives thereof (e.g., cross-linked agarose), and collagen, or solid matrices, such as activated carbon, porous ceramic, and diatomaceous earth. In some embodiments, the matrix is a particle, a membrane, or a fiber. Types of membranes include, among others, nylon, cellulose, polysulfone, or polyacrylate.

In some embodiments, the enzyme is immobilized on the surface of a support material. In some embodiments, the enzyme is adsorbed on the support material. In some embodiments, the enzyme is immobilized on the support material by covalent attachment. Support materials include, among others, inorganic materials, such as alumina, silica, porous glass, ceramics, diatomaceous earth, clay, and bentonite, or organic materials, such as cellulose (CMC, DEAE-cellulose), starch, activated carbon, polyacrylamide, polystyrene, and ion-exchange resins, such as AMBERLITE, SEPHADEX, and DOWEX.

Uses of Engineered DNA ligase Polypeptides and Kits

In another aspect, the present disclosure provides uses of the engineered DNA ligases for ligating or joining of DNA molecules, such as for polynucleotide synthesis, DNA repair, or other molecular biological and diagnostic uses.

In some embodiments, the engineered DNA ligase is used for ligating polynucleotides or oligonucleotides. In some embodiments, the engineered DNA ligase is used for synthesizing polynucleotides from shorter oligonucleotides or polynucleotides. In some embodiments, a method of ligating at least a first polynucleotide strand and a second polynucleotide strand comprises contacting a first polynucleotide strand and a second polynucleotide strand with an engineered DNA ligase described herein in presence of a nucleotide substrate under conditions suitable for ligation of the first polynucleotide strand to the second polynucleotide strand, wherein the first polynucleotide strand comprises a ligatable 5'-end and the second polynucleotide strand comprises a 3'-end ligatable to the 5'-end of the first polynucleotide strand. In some embodiments, the 5' end of the first polynucleotide strand has a 5'-phosphate (e.g., —$PO_4$) and the 3' end of the second polynucleotide strand has a 3' hydroxyl (OH). In some embodiments, the first polynucleotide strand and second polynucleotide strand comprises a DNA, or a mixture of DNA and RNA.

In some embodiments, the method further comprises a third polynucleotide strand, wherein the first polynucleotide strand and second polynucleotide strand hybridize adjacent to one another on the third polynucleotide strand to position the 5'-end of the first polynucleotide strand adjacent to the 3'-end of the second polynucleotide strand. In some embodiments of the method, the third polynucleotide strand is continuous with the first polynucleotide strand or second polynucleotide strand. In some embodiments of the method, the third polynucleotide strand is continuous with the first polynucleotide strand and second polynucleotide strand to form a single continuous polynucleotide ligase substrate. In some embodiments, the first polynucleotide strand, second polynucleotide strand, and third polynucleotide strand comprise separate polynucleotides. In some embodiments, the third polynucleotide strand is RNA, DNA, or a mixture of RNA and DNA, preferably DNA.

In some embodiments of the method, the third polynucleotide comprises a splint or bridging polynucleotide, wherein the 5'-terminal sequence of the first polynucleotide strand and the 3'-terminal sequence of the second polynucleotide strand hybridize adjacent to one another on the splint or bridging polynucleotide to position the 5'-end of the first polynucleotide strand adjacent to the 3'-end of the second polynucleotide strand. In some embodiments, the splint or bridging polynucleotide is RNA, DNA, or a mixture of RNA and DNA, preferably DNA.

In some embodiments of the method, the first polynucleotide strand is hybridized to a third polynucleotide strand to form a first double stranded polynucleotide substrate, and the second polynucleotide strand is hybridized to a fourth polynucleotide strand to form a second double stranded polynucleotide substrate.

In some embodiments, the first double stranded polynucleotide substrate comprises a blunt-ended 5' end of the first polynucleotide strand, and the second double stranded polynucleotide substrate comprises a blunt ended 3' end of the second polynucleotide strand.

In some embodiments, the first double stranded polynucleotide substrate comprises an overhang on at one least end of the first double stranded polynucleotide substrate, and the second double stranded polynucleotide substrate comprises an overhang on at least one end of the second double stranded polynucleotide substrate, where the overhang on the first double stranded polynucleotide substrate and overhang on the second double stranded polynucleotide substrate are complementary and thus capable of hybridizing to each other and form a nick or nicks that can be ligated. In some embodiments, the nick is between the 5'-end of the first polynucleotide strand and the 3'-end of the second polynucleotide strand.

In some embodiments, the first double stranded polynucleotide substrate and second double-stranded polynucleotide substrate comprise DNA, e.g., a first dsDNA substrate and a second dsDNA substrate.

In some embodiments, the DNA ligase substrate comprises an adapter or linker. In some embodiments, the adapter or linker has blunt or cohesive (sticky) ends. In some embodiments, the linker substrate has two blunt ends. In some embodiments, the adapter has one blunt end and one cohesive or sticky end.

In some embodiments, the method includes a nucleotide substrate used by the DNA ligase to catalyze the joining reaction. In some embodiments, the nucleotide substrate is ATP. In some embodiments of the method, the reaction conditions for the ligation reaction include additional components, such as a divalent metal (e.g., $Mg^{+2}$), buffer, reducing agent (e.g., DTT), and/or salts (KCl or NaCl).

In some embodiments, the reaction condition also includes a ligation enhancing reagent, including, among others, DMSO, betaine, polyethylene glycol (e.g., PEG 6000 and PEG 8000) or other molecular crowding reagents, by way example and not limitation, bovine serum albumin (BSA), dextran, 1,2-propanediol, and Ficoll.

In some embodiments, ligation reaction is carried out at a suitable temperature and reaction time period. In some embodiments, the ligation reaction temperature is from about 2° C. to about 50° C. In some embodiments, the ligation reaction temperature is from 2° C. to 45° C., 4° C. to 40° C., 4° C. to 35° C., 4° C. to 30° C., or 10° C. to 25° C. In some embodiments, the ligation reaction temperature is 2° C., 3° C., 4° C., 5° C., 10° C., 15° C., 20° C., 25° C., 30° C., 37° C., 40° C., 45° C., or 50° C. In some embodiments, the ligation reaction temperature can use different temperatures, for example a temperature at which stable hybrids are formed between polynucleotide substrate(s) followed by a higher temperature to promote completion of ligation reaction.

In some embodiments, the ligation reaction time can be a sufficient time for ligation of polynucleotide substrate(s). In some embodiments, the ligation reaction time is from 0.5-72 hr or longer. In some embodiments, the ligation reaction time is 1-72 hr, 2-48 hr, or 2-24 hr. In some embodiments, the ligation reaction time is 0.5, 1, 2, 4, 5, 12, 24, 48, or 72 hr or longer.

In some embodiments, the DNA ligase described herein is used in ligase chain reaction (LCR) or ligase detection reaction (LDR) (see, e.g., Gibriel et al., Mutat Res Rev Mutat Res. 2017, 773:66-90). In some embodiments, the DNA ligase described here is used to generate templates for rolling circle amplification. In some embodiments, the DNA ligase is used for DNA sequencing or single nucleotide polymorphism (SNP) detection, e.g., by supported oligonucleotide ligation and detection (SOLiD).

In a further aspect, the present disclosure provides a kit comprising a DNA ligase described herein. In some embodiments, the kit further comprises one or more of a buffer, a nucleotide substrate (e.g., ATP), and/or one or more polynucleotide ligase substrates, particularly synthetic oligonucleotides or recombinant polynucleotides. In some embodiments, the kit further comprises an additive or ligation enhancing agent, including one or more of DMSO, betaine, polyethylene glycol (e.g., PEG 6000, PEG 8000, etc.), bovine serum albumin, Ficoll, and dextran (e.g., Dextran 6000).

EXAMPLES

The following Examples, including experiments and results achieved, are provided for illustrative purposes only and are not to be construed as limiting the present invention. There are various suitable sources for many of the reagents and equipment described below. It is not intended that the present invention be limited to any particular source for any reagent or equipment item.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); ul, uL, μl, and μL (microliter); cm (centimeters); mm (millimeters); um and μη (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Celsius); RT and rt (room temperature); IPTG (isopropyl β-D-1-thiogalactopyranoside); LB (lysogeny broth); TB (terrific broth); SFP (shake flask powder); CDS (coding sequence); *E. coli* W3110 (commonly used laboratory *E. coli* strain, available from the *Coli* Genetic Stock Center [CGSC], New Haven, CT); HTP (high throughput); FIOPC and FIOP (fold improvements over positive control or fold improvement over parent, respectively).

Example 1

DNA Ligase Gene Acquisition and Construction of Expression Vectors

Genes encoding N-terminal 6-histidine tagged variants of multiple wild-type (WT) dsDNA ligase enzymes were designed with codon optimization for *E. coli* expression, synthesized, and subcloned into the *E. coli* expression vector pCK100900i (See e.g., U.S. Pat. No. 7,629,157 and US Pat. Appln. Publn. 2016/0244787, both of which are hereby incorporated by reference). An *E. coli* strain derived from W3110 was transformed with these plasmid constructs. Directed evolution techniques generally known by those skilled in the art were used to generate libraries of gene variants from these plasmids (See e.g., U.S. Pat. No. 8,383,346 and WO 2010/144103, both of which are hereby incorporated by reference). The substitutions in the enzyme variants described herein are indicated with reference to the N-terminally 6-histidine tagged version of the referenced WT dsDNA ligase enzyme (i.e., SEQ ID NO: 2) or variants thereof, as indicated.

Example 2

DNA Ligase Expression and Heat Lysis in High-Throughput (HTP)

High-Throughput (HTP) Growth of dsDNA Ligase Enzyme and Variants

Transformed *E. coli* cells were selected by plating onto LB agar plates containing 1% glucose and 30 μg/ml chloramphenicol. After overnight incubation at 37° C., colonies were placed into the wells of 96-well shallow flat bottom NUNC™ THERMO-SCIENTIFIC) plates filled with 180 μl/well LB medium supplemented with 1% glucose and 30 μg/ml chloramphenicol. The cultures were allowed to grow overnight for 18-20 hr in a shaker (200 rpm, 30° C., and 85% relative humidity; Kuhner). Overnight growth samples (20 μL) were transferred into COSTAR 96-well deep plates filled with 380 μL of Terrific Broth supplemented with 30 μg/ml chloramphenicol. The plates were incubated for 120 minutes in a shaker (250 rpm, 30° C., and 85% relative humidity; Kuhner) until the $OD_{600}$ reached between 0.4-0.8. The cells were then induced with 40 μL of 10 mM IPTG in sterile water and incubated overnight for 18-20 hr in a shaker (250 rpm, 30° C., and 85% relative humidity; Kuhner). The cells were pelleted (4000 rpm×20 min), the supernatants were discarded, and the cells were frozen at −80° C. prior to analysis.

Heat Lysis of HTP Cell Pellets with Lysozyme

200 μl buffer containing 50 mM Tris-HCl buffer, pH 7.5 were added to the cell pellet in each well. The cells were fully resuspended at room temperature for 15-20 min with shaking on a bench top shaker. At the same time, 60 uL lysis buffer containing 50 mM Tris-HCl buffer, pH 7.5 and 0.2 g/L lysozyme were transferred to a BIORAD plate. 60 μL of fully resuspended cell pellets then were transferred to the BIORAD plate. The plate was fully mixed, and heat challenged at specific temperature for 1 h. The plate was then centrifuged for 15 min at 4,000 rpm and 4° C. The clear supernatants were then used in biocatalytic reactions to determine their activity levels.

Example 3

DNA Ligase Expression and Purification in High-Throughput (HTP)

Transformed *E. coli* cells were selected by plating onto LB agar plates containing 1% glucose and 30 μg/ml chloramphenicol. After overnight incubation at 37° C., colonies were placed into the wells of 96-well shallow flat bottom NUNC™ THERMO-SCIENTIFIC) plates filled with 180 μl/well LB medium supplemented with 1% glucose and 30 μg/ml chloramphenicol. The cultures were allowed to grow overnight for 18-20 hr in a shaker (200 rpm, 30° C., and 85% relative humidity; Kuhner). Overnight growth samples (20 μL) were transferred into COSTAR 96-well deep plates filled with 380 μL of Terrific Broth supplemented with 30 μg/ml chloramphenicol. The plates were incubated for 120 minutes in a shaker (250 rpm, 30° C., and 85% relative humidity; Kuhner) until the $OD_{600}$ reached between 0.4-0.8. The cells were then induced with 40 μL of 10 mM IPTG in sterile water and incubated overnight for 18-20 hr in a shaker (250 rpm, 30° C., and 85% relative humidity; Kuhner). The cells were pelleted (4000 rpm×20 min), the supernatants were discarded, and the cells were frozen at −80° C. prior to analysis.

Lysis of HTP Cell Pellets for HTP Purification of dsDNA Ligase from Crude Lysates Cell pellets were resuspended in 400 μl/well lysis mixture [50 mM Tris-HCl buffer, pH 7.5, 75% (v/v) B-PER reagent (THERMO FISHER), 300 mM NaCl, 10 mM imidazole, and 0.2% (v/v) TRITON X-100 added to the cell suspensions. The mixture was agitated for 2 hr at room temperature, pelleted (4000 rpm×20 min), and supernatants were reserved for purification.

dsDNA ligase was purified from crude *E. coli* extracts by metal-affinity chromatography using HIS-Select® High Capacity (HC) Nickel Coated Plates (SIGMA) according to the manufacturer's instructions. HIS-Select plates were equilibrated with a total of 800 μl of wash buffer (50 mM Tris-HCl, pH 7.5, 500 mM NaCl, 20 mM imidazole, 0.02% v/v TRITON X-100 reagent) per well. Then, 200 μl HTP lysate containing dsDNA ligase per well was loaded onto the plate, and centrifuged for 1 min at 2115 relative centrifugal force (rcf) and 4° C. The plate was washed twice with 400 μl of wash buffer/well, with 2-3 min centrifugations at 2115 rcf and 4° C. for each wash. dsDNA ligase samples were eluted with the addition of 120 μl elution buffer per well (50 mM Tris-HCl, pH 7.5, 500 mM NaCl, 250 mM imidazole, 0.02% v/v TRITON X-100 reagent) by centrifugation for 1 min at 2115 rcf and 4° C.

Eluates were buffer exchanged using Zeba™ Spin desalting plates (THERMO FISHER). Briefly, plates were equilibrated twice with 375 μl of 2×dsDNA ligase storage buffer (80 mM Tris-HCl pH 7.5, 200 mM KCl, and 0.2 mM EDTA) per well and centrifuged for 1 min at 2115 relative centrifugal force (rcf) and 4° C. Desalting plates were loaded with 90 μl HIS-Select sample eluate and centrifuged for 2 min at 2115 rcf and 4° C. The eluate from the desalting plate was retained and mixed with an equal volume of glycerol for a final storage buffer concentration of 40 mM Tris-HCl pH 7.5, 100 mM KCl, 0.1 mM EDTA, and 50% glycerol.

Example 4

Shake Flask Expression and Purification of DNA Ligase

Shake Flask Expression

Selected HTP cultures grown as described above were plated onto LB agar plates with 1% glucose and 30 μg/ml chloramphenicol and grown overnight at 37° C. A single colony from each culture was transferred to 5 ml LB broth with 1% glucose and 30 μg/ml chloramphenicol. The cultures were grown for 20 h at 30° C., 250 rpm, and subcultured at a dilution of approximately 1:50 into 250 ml Terrific Broth with 30 μg/ml of chloramphenicol, to a final $OD_{600}$ of about 0.05. The cultures were incubated for approximately 195 min at 30° C., 250 rpm, to an $OD_{600}$ of about 0.6, and then induced with the addition of IPTG at a final concentration of 1 mM. The induced cultures were incubated for 20 h at 30° C., 250 rpm. Following this incubation period, the cultures were centrifuged at 4000 rpm×10 min. The culture supernatant was discarded, and the pellets were resuspended in 35 ml of 20 mM Tris-HCl buffer, pH 7.5. This cell suspension was chilled in an ice bath and lysed using a Microfluidizer cell disruptor (Microfluidics M-110L). The crude lysate was pelleted by centrifugation (11,000 rpm for 60 min at 4° C.), and the supernatant was then filtered through a 0.2 μm PES membrane to further clarify the lysate.

Purification of DNA Ligase from Shake Flask Lysates

Additional NaCl and imidazole were added to the clarified dsDNA ligase lysates to adjust their concentrations to 500 mM NaCl and 20 mM imidazole respectively. Lysates were then purified using an AKTA Pure purification system and a 5 ml HisTrap FF column (GE Healthcare) using the AC Step HiF setting (the run parameters are provided below). The SF wash buffer comprised 50 mM Tris-HCl, 500 mM NaCl, 20 mM imidazole, 0.02% v/v TRITON X-100 reagent.

TABLE 3.1

| Purification Parameters | |
|---|---|
| Parameter | Volume |
| Column volume | 5 mL |
| Flow rate | 5 mL/min |
| Pressure limit | 0.3 MPa |
| Sample volume | 45 ml |
| Equilibration volume | 5 column volumes (CV) = 25 mL |
| Wash Unbound volume | 15CV = 75 mL |
| Elution | Isocratic (step) |
| Elution volume | 5 CV = 25 mL |
| Fraction volume | 1 mL |
| RE-equilibration volume | 5 CV = 25 mL |

The three most concentrated 1 ml fraction were identified by UV absorption (280 nm), and dialyzed overnight in dialysis buffer (40 mM Tris-HCl, pH 7.5, 100 mM KCl, 0.1 mM EDTA, and 50% glycerol) in a 3.5K Slide-A-Lyzer™ dialysis cassette (THERMO FISHER) for buffer exchange. Concentrations of purified and dialyzed dsDNA ligase samples were measured by absorption at 280 nm.

Example 5 dsDNA 50-Mer Insert Preparation for HTP Screening

A 6-carboxyfluorescein-labeled double-stranded 50-mer DNA fragment comprised of two single-strand HPLC-purified synthetic oligonucleotides (INTEGRATED DNA TECHNOLOGIES) was prepared by annealing these two oligonucleotides in 1× annealing buffer (10 mM Tris-HCl pH 7.5, 50 mM NaCl, 10 mM EDTA). The resulting double-stranded "50-mer fluorescently labeled insert" has single-base deoxyadenine 3' overhangs and 5' monophosphate ends on both ends of the molecule and is internally labeled with a fluorescent dye (6-carboxyfluorescein attached to 5 position of thymine ring via a 6-carbon spacer arm).

Example 6 dsDNA 20-Mer Adapter Preparation for HTP Screening

A double-stranded "20-mer adapter" molecule comprising two single-stranded HPLC-purified oligonucleotides (INTEGRATED DNA TECHNOLOGIES) (SEQ ID NO: 1217 and SEQ ID NO: 1218) was prepared by annealing in 1× annealing buffer (10 mM Tris pH 7.5, 50 mM NaCl, 10 mM EDTA). The resulting 20-mer adapter duplex has a phosphorothioate-protected 5' deoxythymidine overhang and 5' phosphate at the ligation-compatible end.

Example 7

Capillary Electrophoresis (CE) Analysis of Oligonucleotides

Sample Preparation for Reaction Analysis Using CE

Reaction samples were analyzed via capillary electrophoresis using an ABI 3500XL GENETIC ANALYZER (THERMO FISHER). Reactions (25 μL) were quenched by the addition of 5 μL of 50 mM aqueous EDTA. 2 μL of this quenched solution was transferred to a new 96-well MicroAmp Optical PCR plate or 384-well MicroAmp Optical PCR plate containing 18 μL Hi-Di™ Formamide (THERMO FISHER) which has an appropriate size standard. The ABI3500xl was configured with POP6 polymer, 50 cm capillaries and a 45° C. oven temperature. Pre-run settings were 18 KV for 180 sec. Injection was 5 KV for 5 sec, and the run settings were 19.5 KV for 1500 sec. FAM-labeled oligo substrates and products were identified by their sizes relative to the sizing ladder, with the substrate oligo peak at ~49 bp and the ligated product appearing in the region of ~85 bp.

Example 8

*E. coli* Shake Flask Expression, Purification, and Activity Validation of Recombinant DNA Ligase Genes Twenty genes (SEQ ID: 1/2-SEQ ID: 37/38), cloned for recombinant expression in *E. coli* as described in Example 1, were expressed and purified as described in Example 4.

Ligation reactions were performed in 96-well format 200 μL BIORAD PCR plates. Reactions included 1 nM insert (SEQ ID: 1185/SEQ ID: 1186), 200 nM adapter (SEQ ID: 1217/SEQ ID: 1218) and 1× ligation buffer containing 66 mM Tris-HCl buffer at pH 7.5, 10 mM $MgCl_2$, 1 mM DTT, 1 mM ATP. The reactions were set up as follows: (i) all reaction components, except for purified dsDNA ligase, were pre-mixed in a single solution, and 80 μL of this solution was aliquoted into each well of the 96-well plates (ii) 20 μL of purified dsDNA ligase solution (1.28 uM as final concentration) was then added into the wells to initiate the reaction. The reaction plate was heat-sealed with a peelable aluminum seal and incubated in a thermocycler at 23° C. for 30 min, then held at 4° C. until the reaction was quenched.

Reactions were quenched by the addition of 20 uL of 90 mM EDTA, followed by addition of 20 uL of 2.8 g/L proteinase K in water (0.2 g/L proteinase K as final concentration). The quenched reactions were incubated in a thermocycler at 50° C. for 2 hr, then cleaned up with ZR-96 DNA clean and concentrator-5 (catalog #D4024, the clean-up protocol was included in the kit). The cleaned-up mixtures were analyzed with the CALIPER (PERKLIN ELMER) Labchip GX capillary electrophoresis instrument using the DNA high sensitivity assay, according to the manufacturer's instructions.

Conversion was calculated as double-ligated product peak areas over the total of the unligated insert, single ligated, and double-ligated product peak areas. The results are shown in Table 8.1. The amino acid sequence identities (without the His-tag) between each of the DNA ligases examined are shown in Table 8.2.

TABLE 8.1

| SEQ ID NO: (nt/aa) | % Conversion |
|---|---|
| 1/2 | +++ |
| 3/4 | + |
| 5/6 | + |
| 7/8 | + |
| 9/10 | + |
| 11/12 | + |
| 13/14 | + |
| 15/16 | + |
| 17/18 | + |
| 19/20 | + |
| 21/22 | + |
| 23/24 | + |
| 25/26 | + |

TABLE 8.1-continued

| SEQ ID NO: (nt/aa) | % Conversion |
|---|---|
| 27/28 | ++ |
| 29/30 | + |
| 31/32 | + |
| 33/34 | ++ |
| 35/36 | ++ |
| 37/38 | ++ |

Levels of increased activity were determined relative to their % conversion and defined as follows:
"+" from 0% to 4% (first 50%),
"++" from 5% to 50% (next 30%),
"+++" >50% (top 20%)

TABLE 8.2

| SEQ ID NO: | 4 | 6 | 8 | 10 | 12 | 14 | 16 | 18 | 20 | 22 | 24 | 26 | 2 | 28 | 30 | 32 | 34 | 36 | 38 |
|---|---|---|---|---|---|---|---|---|---|---|---|---|---|---|---|---|---|---|---|
| 4 | 100 | 51 | 59 | 59 | 59 | 51 | 67 | 58 | 62 | 52 | 62 | 61 | 13 | 10 | 13 | 10 | 25 | 10 | 11 |
| 6 | 51 | 100 | 48 | 51 | 56 | 62 | 54 | 49 | 52 | 58 | 53 | 51 | 12 | 11 | 12 | 11 | 25 | 10 | 10 |
| 8 | 59 | 48 | 100 | 56 | 55 | 48 | 60 | 55 | 62 | 51 | 59 | 59 | 12 | 12 | 12 | 10 | 22 | 10 | 10 |
| 10 | 59 | 51 | 56 | 100 | 59 | 53 | 65 | 56 | 58 | 54 | 61 | 57 | 14 | 10 | 13 | 11 | 22 | 10 | 12 |
| 12 | 59 | 56 | 55 | 59 | 100 | 52 | 62 | 55 | 57 | 55 | 58 | 60 | 13 | 11 | 14 | 11 | 25 | 10 | 12 |
| 14 | 51 | 62 | 48 | 53 | 52 | 100 | 54 | 51 | 49 | 55 | 53 | 51 | 11 | 11 | 13 | 10 | 23 | 9 | 9 |
| 16 | 67 | 54 | 60 | 65 | 62 | 54 | 100 | 57 | 62 | 56 | 65 | 66 | 14 | 12 | 13 | 11 | 24 | 11 | 12 |
| 18 | 58 | 49 | 55 | 56 | 55 | 51 | 57 | 100 | 64 | 51 | 55 | 57 | 12 | 11 | 13 | 10 | 23 | 9 | 9 |
| 20 | 62 | 52 | 62 | 58 | 57 | 49 | 62 | 64 | 100 | 52 | 59 | 59 | 12 | 11 | 13 | 10 | 22 | 10 | 10 |
| 22 | 52 | 58 | 51 | 54 | 55 | 55 | 56 | 51 | 52 | 100 | 57 | 52 | 13 | 9 | 13 | 11 | 23 | 10 | 10 |
| 24 | 62 | 53 | 59 | 61 | 58 | 53 | 65 | 55 | 59 | 57 | 100 | 62 | 13 | 11 | 13 | 10 | 23 | 9 | 11 |
| 26 | 61 | 51 | 59 | 57 | 60 | 51 | 66 | 57 | 59 | 52 | 62 | 100 | 13 | 12 | 13 | 11 | 23 | 10 | 9 |
| 2 | 13 | 12 | 12 | 14 | 13 | 11 | 14 | 12 | 12 | 13 | 13 | 13 | 100 | 12 | 20 | 15 | 14 | 14 | 12 |
| 28 | 10 | 11 | 12 | 10 | 11 | 11 | 12 | 11 | 11 | 9 | 11 | 12 | 12 | 100 | 13 | 24 | 13 | 21 | 23 |
| 30 | 13 | 12 | 12 | 13 | 14 | 13 | 13 | 13 | 13 | 13 | 13 | 13 | 20 | 13 | 100 | 16 | 15 | 14 | 14 |
| 32 | 10 | 11 | 10 | 11 | 11 | 10 | 11 | 10 | 10 | 11 | 10 | 11 | 15 | 24 | 16 | 100 | 15 | 23 | 25 |
| 34 | 25 | 25 | 22 | 22 | 25 | 23 | 24 | 23 | 22 | 23 | 23 | 23 | 14 | 13 | 15 | 15 | 100 | 13 | 11 |
| 36 | 10 | 10 | 10 | 10 | 10 | 9 | 11 | 9 | 10 | 10 | 9 | 10 | 14 | 21 | 14 | 23 | 13 | 100 | 19 |
| 38 | 11 | 10 | 10 | 12 | 12 | 9 | 12 | 9 | 10 | 10 | 11 | 9 | 12 | 23 | 14 | 25 | 11 | 19 | 100 |

Example 9

Improvements Over SEQ ID NO: 2 in DNA Ligase Activity

HTP Screening for Improved dsDNA Ligase Variants

SEQ ID NO: 2 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 9.1.

Ligation reactions were performed in 96-well format 200 μL BIORAD PCR plates. Reactions included insert, adapter and reaction buffer as described in Table 9.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 9.1. The quenched reactions were followed by Capillary electrophoresis (CE) sample preparation described in Table 9.1.

TABLE 9.1

| All lysis, purification, reaction, quench, and analytical properties |
|---|
| Lysis and purification conditions: Lysis buffer - 50 mM Tris-HCl buffer, pH 7.5, 75% (v/v) B-Per reagent (Thermo Fisher), 300 mM NaCl, 10 mM imidazole, and 0.2% (v/v) Triton X-100; Lysis buffer volume - 400 μL; lysate pre-treatment - lysates were processed and purified as described in Example 3. The HTP-purified enzymes were used in reactions. |
| Reaction conditions: Insert - 1 nM SEQ ID: 1193/SEQ ID: 1194, prepared as described in Example 5; Adapter - 200 nM SEQ ID: 1217/SEQ ID: 1218, prepared as described in Example 6; Reaction buffer - 66 mM Tris-HCl, pH 7.5, 10 mM Magnesium chloride, 1 mM ATP, 1 mM DTT; Lysate dilution - None; Reaction temperature - 23° C.; Reaction time - 1 hour |
| Quench conditions: Reactions were quenched by addition of 5 uL of 50 mM EDTA, followed by capillary electrophoresis (CE) sample preparation as described in Example 7 |
| Analytical conditions: Instrument - capillary electrophoresis (CE) ABI 3500xl Genetic Analyzer - see Example 7 |

Activity relative to SEQ ID NO: 2 (Activity FIOP) was calculated as the fold-improvement of conversion of the variant divided by the conversion observed in the reaction with SEQ ID NO: 2 (where the conversion may be set as the average of replicates or else the highest single sample as appropriate). Conversion was calculated as double-ligated product peak areas over the total of the unligated insert, single ligated, and double-ligated product peak areas. The results are shown in Table 9.2.

TABLE 9.2

| Relative to SEQ ID NO: 2 | | |
|---|---|---|
| SEQ ID NO: (nt/aa) | Amino Acid Differences (Relative to SEQ ID NO: 2) | Activity FIOP Conversion Relative to SEQ ID NO: 2 |
| 39/40 | S233T | +++ |
| 41/42 | T317Q | +++ |
| 43/44 | S191T | ++ |
| 45/46 | L288I | ++ |
| 47/48 | I207L | ++ |
| 49/50 | A149P | + |
| 51/52 | V251L | + |
| 53/54 | Q205E | + |
| 55/56 | I269L | + |
| 57/58 | K164A | + |

Levels of increased activity were determined relative to the reference polypeptide of SEQ ID NO: 2 and defined as follows:
"+" 1.02 to 1.07 (first 50%),
"++" >1.07 (next 30%),
"+++" >1.22 (top 20%)

Example 10

Improvements Over SEQ ID NO: 2 in DNA Ligase Activity

HTP Screening for Improved dsDNA Ligase Variants

SEQ ID NO: 2 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 10.1.

Ligation reactions were performed in 96-well format 200 μL BIORAD PCR plates. Reactions included Insert, adapter and reaction buffer described in Table 10.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 10.1. The quenched reactions were followed by Capillary electrophoresis (CE) sample preparation described in Table 10.1.

TABLE 10.1

| All lysis, purification, reaction, quench, and analytical properties |
|---|
| Lysis and purification conditions: Lysis buffer - 50 mM Tris-HCl buffer, pH 7.5, 75% (v/v) B-Per reagent (Thermo Fisher), 300 mM NaCl, 10 mM imidazole, and 0.2% (v/v) Triton X-100; Lysis buffer volume - 400 μL; Lysate pre-treatment - Lysates were processed and purified as described in Example 3. The HTP purified enzymes were used in reactions. |
| Reaction conditions: Insert - 1 nM SEQ ID: 1193/SEQ ID: 1194, prepared as described in Example 5; Adapter - 200 nM SEQ ID: 1217/SEQ ID: 1218, prepared as described in Example 6; Reaction buffer - 66 mM Tris-HCl, pH 7.5, 10 mM Magnesium chloride, 1 mM ATP, 1 mM DTT; Lysate dilution - None; Reaction temperature - 23° C.; Reaction time - 1 hour |
| Quench conditions: Quench solution and volume - Reactions were quenched by addition of 5 uL of 50 mM |
| EDTA, followed by Capillary electrophoresis (CE) sample preparation as described in Example 7 |
| Analytical conditions: Instrument - capillary electrophoresis (CE) ABI 3500xl Genetic Analyzer - see Example 7 |

Activity relative to SEQ ID NO: 2 (Activity FIOP) was calculated as the fold improvement of the intermediate product conversion of the variant divided by the intermediate product conversion observed in the reaction with SEQ ID NO: 2 (where the intermediate product conversion may be set as the average of replicates or else the highest single sample as appropriate). The intermediate product conversion was calculated as single-ligated product peak areas over the total of the unligated insert and single-ligated product peak areas. The results are shown in Table 10.2.

TABLE 10.2

| Relative to SEQ ID NO: 2 | | |
|---|---|---|
| SEQ ID NO: (nt/aa) | Amino Acid Differences (Relative to SEQ ID NO: 2) | Activity FIOP Intermediate Product Conversion Relative to SEQ ID NO: 2 |
| 59/60 | E36T | + |
| 61/62 | E428R | + |
| 63/64 | L105K/K132R | + |
| 65/66 | L105K | + |

Levels of increased activity were determined relative to the reference polypeptide of SEQ ID NO: 2 and defined as follows:
"+" from 1.00 to 1.58

Example 11

Improvements Over SEQ ID NO: 62 in DNA Ligase Activity

HTP Screening for Improved dsDNA Ligase Variants

SEQ ID NO: 62 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 11.1.

Ligation reactions were performed in 96-well format 200 μL BioRad PCR plates. Reactions included Insert, adapter and reaction buffer described in Table 11.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 11.1. The quenched reactions were followed by Capillary electrophoresis (CE) sample preparation described in Table 11.1.

TABLE 11.1

| All lysis, purification, reaction, quench, and analytical properties |
|---|
| Lysis and purification conditions: Lysis buffer - 50 mM Tris-HCl buffer, pH 7.5, 75% (v/v) B-Per reagent (Thermo Fisher), 300 mM NaCl, 10 mM imidazole, and 0.2% (v/v) Triton X-100; Lysis buffer volume - 400 μL; Lysate pre-treatment - Lysates were processed and purified as described in Example 3. The HTP purified enzymes were preincubated in 37° C. for 15 min and centrifuged in 4° C. for 10 min. The heat-treated HTP purified enzymes were used in reactions. |
| Reaction conditions: Insert - 1 nM SEQ ID: 1185/SEQ ID: 1186 or 1 nM SEQ ID: 1201/SEQ ID: 1202, prepared as described in Example 5; Adapter - 200 nM SEQ ID: 1217/SEQ ID: 1218, prepared as described in Example 6; Reaction buffer - 66 mM Tris-HCl, pH 7.5, 10 mM Magnesium chloride, 1 mM ATP, 1 mM DTT; Lysate dilution - None; Reaction temperature - 23° C.; Reaction time - 1 hour |
| Quench conditions: Quench solution and volume - Reactions were quenched by addition of 5 uL of 50 mM EDTA, followed by Capillary electrophoresis (CE) sample preparation described in Example 7 |
| Analytical conditions: Instrument - capillary electrophoresis (CE) ABI 3500xl Genetic Analyzer - see Example 7 |

Activity relative to SEQ ID NO: 62 (Activity FIOP) was calculated as the fold-improvement of conversion of the variant divided by the conversion observed in the reaction with SEQ ID NO: 62 (where the conversion may be set as the average of replicates or else the highest single sample as appropriate). Conversion was calculated as double-ligated product peak areas over the total of the unligated insert, single ligated, and double-ligated product peak areas. The results are shown in Table 11.2.

TABLE 11.2

| Activity FIOP Relative to SEQ ID NO: 62 | | | |
|---|---|---|---|
| SEQ ID NO: (nt/aa) | Amino Acid Differences (Relative to SEQ ID NO: 2) | Amino Acid Differences (Relative to SEQ ID NO: 62) | Activity FIOP Conversion Relative to SEQ ID NO: 62 |
| 67/68 | I196E/E428R | I196E | +++ |
| 69/70 | V242P/E428R | V242P | +++ |
| 71/72 | F337L/E428R | F337L | ++ |
| 73/74 | T33R/E428R | T33R | ++ |
| 75/76 | T33V/E428R | T33V | ++ |
| 77/78 | E277Q/E428R | E277Q | ++ |

TABLE 11.2-continued

| SEQ ID NO: (nt/aa) | Amino Acid Differences (Relative to SEQ ID NO: 2) | Amino Acid Differences (Relative to SEQ ID NO: 62) | Activity FIOP Conversion Relative to SEQ ID NO: 62 |
|---|---|---|---|
| Activity FIOP Relative to SEQ ID NO: 62 | | | |
| 79/80 | F337P/E428R | F337P | ++ |
| 81/82 | T30C/E428R | T30C | ++ |
| 83/84 | K359N/E428R | K359N | + |
| 85/86 | F337G/E428R | F337G | + |
| 87/88 | F283S/E428R | F283S | + |
| 89/90 | V242Q/E428R | V242Q | + |
| 91/92 | T415A/E428R | T415A | + |
| 93/94 | T387G/E428R | T387G | + |
| 95/96 | T415H/E428R | T415H | + |
| 97/98 | E379A/E428R | E379A | + |
| 99/100 | Q205G/E428R | Q205G | + |
| 101/102 | K186M/E428R | K186M | + |
| 103/104 | F337M/E428R | F337M | + |
| 105/106 | E389Q/E428R | E389Q | + |
| 107/108 | N102L/E428R | N102L | + |
| 109/110 | E389L/E428R | E389L | + |
| 111/112 | K359R/E428R | K359R | + |
| 113/114 | Q205K/E428R | Q205K | + |
| 115/116 | K164A/E428R | K164A | + |
| 117/118 | T415E/E428R | T415E | + |
| 119/120 | E301F/E428R | E301F | + |
| 121/122 | T30H/E428R | T30H | + |
| 123/124 | E379G/E428R | E379G | + |
| 125/126 | Y375W/E428R | Y375W | + |
| 127/128 | Q267W/E428R | Q267W | + |
| 129/130 | V380T/E428R | V380T | + |
| 131/132 | T415C/E428R | T415C | + |
| 133/134 | H254G/E428R | H254G | + |
| 135/136 | K186T/E428R | K186T | + |
| 137/138 | T317Q/E428R | T317Q | ++ |
| 139/140 | Y77D/S139T/T317Q/S417G/E428R | Y77D/S139T/T317Q/S417G | + |
| 141/142 | L105K/T317Q/S417G/E428R | L105K/T317Q/S417G | + |
| 143/144 | T317Q/D349E/T362G/Y386F/E428R | T317Q/D349E/T362G/Y386F | + |
| 145/146 | L105K/T317Q/E428R | L105K/T317Q | + |
| 147/148 | S139T/T317Q/T362G/E428R | S139T/T317Q/T362G | + |
| 149/150 | S233T/T317Q/V405I/E428R | S233T/T317Q/V405I | + |
| 151/152 | S139T/T317Q/E428R | S139T/T317Q | + |
| 153/154 | Y162W/E428R | Y162W | +++ |
| 155/156 | F283V/E428R | F283V | +++ |
| 157/158 | W286S/E428R | W286S | +++ |
| 159/160 | S414L/E428R | S414L | +++ |
| 161/162 | S417L/E428R | S417L | +++ |
| 163/164 | K226S/E428R | K226S | +++ |
| 165/166 | I61T/E428R | I61T | +++ |
| 167/168 | K226Q/E428R | K226Q | +++ |
| 169/170 | L105S/E428R | L105S | +++ |
| 171/172 | K186E/E428R | K186E | +++ |
| 173/174 | V230M/E428R | V230M | +++ |
| 175/176 | I61V/E428R | I61V | +++ |
| 177/178 | K186V/E428R | K186V | +++ |
| 179/180 | K186L/E428R | K186L | +++ |
| 181/182 | E379P/E428R | E379P | +++ |
| 183/184 | T415V/E428R | T415V | +++ |
| 185/186 | T415I/E428R | T415I | ++ |
| 187/188 | K186A/E428R | K186A | ++ |
| 189/190 | F283R/E428R | F283R | ++ |
| 191/192 | K226V/E428R | K226V | ++ |
| 193/194 | K418L/E428R | K418L | ++ |
| 195/196 | K418S/E428R | K418S | ++ |
| 197/198 | A370G/E428R | A370G | ++ |
| 199/200 | F283A/E428R | F283A | ++ |
| 201/202 | F337S/E428R | F337S | ++ |
| 203/204 | F297W/E428R | F297W | ++ |
| 205/206 | K237S/E428R | K237S | ++ |
| 207/208 | E428S | R428S | ++ |
| 209/210 | K186C/E428R | K186C | ++ |
| 211/212 | T362G/E428R | T362G | ++ |
| 213/214 | F283G/E428R | F283G | ++ |
| 215/216 | I196V/E428R | I196V | ++ |
| 217/218 | K237L/E428R | K237L | ++ |
| 219/220 | T415L/E428R | T415L | ++ |
| 221/222 | S233W/E428R | S233W | ++ |
| 223/224 | V242T/E428R | V242T | ++ |

TABLE 11.2-continued

| Activity FIOP Relative to SEQ ID NO: 62 | | | |
|---|---|---|---|
| SEQ ID NO: (nt/aa) | Amino Acid Differences (Relative to SEQ ID NO: 2) | Amino Acid Differences (Relative to SEQ ID NO: 62) | Activity FIOP Conversion Relative to SEQ ID NO: 62 |
| 225/226 | E277R/E428R | E277R | + |
| 227/228 | F235W/E428R | F235W | + |
| 229/230 | I148P/E428R | I148P | + |
| 231/232 | H254S/E428R | H254S | + |
| 233/234 | N102G/E428R | N102G | + |
| 235/236 | L105T/E428R | L105T | + |
| 237/238 | E301L/E428R | E301L | + |
| 239/240 | W286F/E428R | W286F | + |
| 241/242 | T100V/E428R | T100V | + |
| 243/244 | K237Y/E428R | K237Y | + |
| 245/246 | T30S/E428R | T30S | + |
| 247/248 | E428F | R428F | + |

Levels of increased activity were determined relative to the reference polypeptide of SEQ ID NO: 62 and defined as follows:
"+"1.00 to 1.62 (first 50%),
"++" >1.62 (next 30%),
"+++" >2.81 (top 20%)

Example 12

Improvements Over SEQ ID NO: 62 in in DNA Ligase Activity

HTP Screening for Improved dsDNA Ligase Variants

SEQ ID NO: 62 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 12.1.

Ligation reactions were performed in 96-well format 200 μL BIORAD PCR plates. Reactions included Insert, adapter and reaction buffer described in Table 12.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 12.1. The quenched reactions were followed by Capillary electrophoresis (CE) sample preparation described in Table 12.1.

TABLE 12.1

| All lysis, purification, reaction, quench, and analytical properties |
|---|
| Lysis and purification conditions: Lysis buffer - 50 mM Tris-HCl buffer, pH 7.5, 75% (v/v) B-Per reagent (Thermo Fisher), 300 mM NaCl, 10 mM imidazole, and 0.2% (v/v) Triton X-100; Lysis buffer volume - 400 μL; Lysate pre-treatment - Lysates were processed and purified as described in Example 3. The HTP purified enzymes were preincubated in 42° C. for 15 min and centrifuged in 4° C. for 10 min. The heat-treated HTP purified enzymes were used in reactions. |
| Reaction conditions: Insert - 1 nM SEQ ID: 1209/SEQ ID: 1210, prepared as described in Example 5; Adapter - 200 nM SEQ ID: 1217/SEQ ID: 1218, prepared as described in Example 6; Reaction buffer - 66 mM Tris-HCl, pH 7.5, 10 mM Magnesium chloride, 1 mM ATP, 1 mM DTT; Lysate dilution - None; Reaction temperature - 23° C.; Reaction time - 1 hour |
| Quench conditions: Quench solution and volume - Reactions were quenched by addition of 5 uL of 50 mM |
| EDTA, followed by Capillary electrophoresis (CE) sample preparation described in Example 7 |
| Analytical conditions: Instrument - capillary electrophoresis (CE) ABI 3500xl Genetic Analyzer - see Example 7 |

Activity relative to SEQ ID NO: 62 (Activity FIOP) was calculated as the fold-improvement of conversion of the variant divided by the conversion observed in the reaction with SEQ ID NO: 62 (where the conversion may be set as the average of replicates or else the highest single sample as appropriate). Conversion was calculated as double-ligated product peak areas over the total of the unligated insert, single ligated, and double-ligated product peak areas. The results are shown in Table 12.2.

TABLE 12.2

| Activity FIOP Relative to SEQ ID NO: 62 | | | |
|---|---|---|---|
| SEQ ID NO: (nt/aa) | Amino Acid Differences (Relative to SEQ ID NO: 2) | Amino Acid Differences (Relative to SEQ ID NO: 62) | Activity FIOP Conversion Relative to SEQ ID NO: 62 |
| 249/250 | S414Q/E428R | S414Q | +++ |
| 251/252 | S414V/E428R | S414V | +++ |
| 253/254 | F283L/E428R | F283L | +++ |
| 255/256 | S414A/E428R | S414A | +++ |
| 257/258 | S414R/E428R | S414R | +++ |
| 259/260 | A370C/E428R | A370C | +++ |
| 261/262 | F283K/E428R | F283K | ++ |
| 263/264 | W286L/E428R | W286L | ++ |
| 265/266 | K186H/E428R | K186H | ++ |
| 267/268 | S417D/E428R | S417D | ++ |

TABLE 12.2-continued

| Activity FIOP Relative to SEQ ID NO: 62 | | | |
|---|---|---|---|
| SEQ ID NO: (nt/aa) | Amino Acid Differences (Relative to SEQ ID NO: 2) | Amino Acid Differences (Relative to SEQ ID NO: 62) | Activity FIOP Conversion Relative to SEQ ID NO: 62 |
| 269/270 | K226D/E428R | K226D | ++ |
| 271/272 | S233G/E428R | S233G | ++ |
| 273/274 | Q267Y/E428R | Q267Y | ++ |
| 275/276 | R97G/E428R | R97G | ++ |
| 277/278 | K226E/E428R | K226E | ++ |
| 279/280 | K418T/E428R | K418T | ++ |
| 281/282 | V230L/E428R | V230L | + |
| 283/284 | S414T/E428R | S414T | + |
| 285/286 | K418A/E428R | K418A | + |
| 287/288 | K237V/E428R | K237V | + |
| 289/290 | K418G/E428R | K418G | + |
| 291/292 | I382V/E428R | I382V | + |
| 293/294 | Q267D/E428R | Q267D | + |
| 295/296 | F283M/E428R | F283M | + |
| 297/298 | K418P/E428R | K418P | + |
| 299/300 | K237R/E428R | K237R | + |
| 301/302 | K237M/E428R | K237M | + |
| 303/304 | K418I/E428R | K418I | + |
| 305/306 | G358C/E428R | G358C | + |
| 307/308 | K186R/E428R | K186R | + |
| 309/310 | K418M/E428R | K418M | + |
| 311/312 | N102S/E428R | N102S | + |

Levels of increased activity were determined relative to the reference polypeptide of SEQ ID NO: 62 and defined as follows:
"+" from 2.64 to 7.93 (first 50%),
"++" >7.93 (next 30%),
"+++" >19.68 (top 20%)

Example 13

Improvements Over SEQ ID NO: 138 in DNA Ligase Activity and Thermostability

HIP Screening for Improved dsDNA Ligase Variants

SEQ ID NO: 138 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 13.1.

Ligation reactions were performed in 96-well format 200 μL BIORAD PCR plates. Reactions included insert, adapter and reaction buffer described in Table 13.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 13.1. The quenched reactions were followed by Capillary electrophoresis (CE) sample preparation described in Table 13.1.

TABLE 13.1

| All lysis, purification, reaction, quench, and analytical properties |
|---|
| Lysis and purification conditions: Lysis buffer - 50 mM Tris-HCl buffer, pH 7.5, 75% (v/v) B-Per reagent (Thermo Fisher), 300 mM NaCl, 10 mM imidazole, and 0.2% (v/v) Triton X-100; Lysis buffer volume - 400 μL; Lysate pre-treatment - Lysates were processed and purified as described in Example 3. The HTP purified enzymes were preincubated in 40° C. for 15 min and centrifuged in 4° C. for 10 min. The heat-treated HTP purified enzymes were used in reactions. |
| Reaction conditions: Insert - 1 nM SEQ ID: 1209/SEQ ID: 1210, prepared as described in Example 5; Adapter - 200 nM SEQ ID: 1217/SEQ ID: 1218, prepared as described in Example 6; Reaction buffer - 66 mM Tris-HCl, pH 7.5, 10 mM Magnesium chloride, 1 mM ATP, 1 mM DTT; Lysate dilution - None; Reaction temperature - 23° C.; Reaction time - 1 hour |
| Quench conditions: Quench solution and volume - Reactions were quenched by addition of 5 uL of 50 mM EDTA, followed by Capillary electrophoresis (CE) sample preparation described in Example 7 |
| Analytical conditions: Instrument - capillary electrophoresis (CE) ABI 3500xl Genetic Analyzer - see Example 7 |

Activity relative to SEQ ID NO: 138 (Activity FIOP) was calculated as the fold-improvement of conversion of the variant divided by the conversion observed in the reaction with SEQ ID NO: 138 (where the conversion may be set as the average of replicates or else the highest single sample as appropriate). Conversion was calculated as double-ligated product peak areas over the total of the unligated insert, single ligated, and double-ligated product peak areas. The results are shown in Table 13.2.

TABLE 13.2

| Activity FIOP Relative to SEQ ID NO: 138 | | | |
|---|---|---|---|
| SEQ ID NO: (nt/aa) | Amino Acid Differences (Relative to SEQ ID NO: 2) | Amino Acid Differences (Relative to SEQ ID NO: 138) | Activity FIOP Conversion Relative to SEQ ID NO: 138 |
| 313/314 | V242Q/F283V/W286S/T317Q/K359R/K418L/E428R | V242Q/F283V/W286S/K359R/K418L | +++ |

TABLE 13.2-continued

| Activity FIOP Relative to SEQ ID NO: 138 | | | |
|---|---|---|---|
| SEQ ID NO: (nt/aa) | Amino Acid Differences (Relative to SEQ ID NO: 2) | Amino Acid Differences (Relative to SEQ ID NO: 138) | Activity FIOP Conversion Relative to SEQ ID NO: 138 |
| 315/316 | F283L/W286S/T317Q/E428R | F283L/W286S | +++ |
| 317/318 | F283L/W286S/T317Q/K418S/E428R | F283L/W286S/K418S | +++ |
| 319/320 | K186E/V242Q/F283V/W286S/T317Q/K418L/E428R | K186E/V242Q/F283V/W286S/K418L | +++ |
| 321/322 | Q205K/W286S/T317Q/K359R/E428R | Q205K/W286S/K359R | +++ |
| 323/324 | F283V/T317Q/E428R | F283V | +++ |
| 325/326 | V242P/W286S/T317Q/K418T/E428R | V242P/W286S/K418T | +++ |
| 327/328 | K186E/Q205K/V242T/T317Q/E428R | K186E/Q205K/V242T | +++ |
| 329/330 | F283L/W286S/T317Q/K359R/E428R | F283L/W286S/K359R | +++ |
| 331/332 | E277Q/W286S/T317Q/K359N/K418T/E428R | E277Q/W286S/K359N/K418T | +++ |
| 333/334 | K186A/Q205K/F283V/W286S/T317Q/K359R/E428R | K186A/Q205K/F283V/W286S/K359R | +++ |
| 335/336 | V242Q/E277Q/T317Q/K418L/E428R | V242Q/E277Q/K418L | +++ |
| 337/338 | V242Q/F283S/W286S/T317Q/K418T/E428R | V242Q/F283S/W286S/K418T | +++ |
| 339/340 | L112M/I196V/T317Q/E389Q/E428R | L112M/I196V/E389Q | +++ |
| 341/342 | W286S/T317Q/E428R | W286S | ++ |
| 343/344 | V242P/F283R/W286S/T317Q/K359R/K418L/E428R | V242P/F283R/W286S/K359R/K418L | ++ |
| 345/346 | F283L/W286S/T317Q/K359R/K418S/E428R | F283L/W286S/K359R/K418S | ++ |
| 347/348 | V242Q/T317Q/K359N/K418S/E428R | V242Q/K359N/K418S | ++ |
| 349/350 | K186E/F283L/T317Q/E428R | K186E/F283L | ++ |
| 351/352 | K186E/T317Q/K359R/K418S/E428R | K186E/K359R/K418S | ++ |
| 353/354 | Q205K/V242T/T317Q/K418S/E428R | Q205K/V242T/K418S | ++ |
| 355/356 | K186E/Q205K/V242Q/F283S/W286S/T317Q/K359R/K418S/E428R | K186E/Q205K/V242Q/F283S/W286S/K359R/K418S | ++ |
| 357/358 | Q205K/T317Q/K359N/K418L/E428R | Q205K/K359N/K418L | ++ |
| 359/360 | K186A/Q205K/F283L/W286S/T317Q/K418L/E428R | K186A/Q205K/F283L/W286S/K418L | ++ |
| 361/362 | V242T/F283V/W286S/T317Q/K359R/K418S/E428R | V242T/F283V/W286S/K359R/K418S | ++ |
| 363/364 | K186E/F283L/T317Q/K359R/E428R | K186E/F283L/K359R | ++ |
| 365/366 | K186E/V242P/T317Q/E428R | K186E/V242P | ++ |
| 367/368 | F283V/W286S/T317Q/K418S/E428R | F283V/W286S/K418S | ++ |
| 369/370 | K186E/V242T/T317Q/K359R/E428R | K186E/V242T/K359R | ++ |
| 371/372 | F283L/T317Q/K359R/K418L/E428R | F283L/K359R/K418L | ++ |
| 373/374 | E277Q/T317Q/K418S/E428R | E277Q/K418S | ++ |
| 375/376 | K186E/V188A/F283V/T317Q/E428R | K186E/V188A/F283V | ++ |
| 377/378 | K186E/W286S/T317Q/K418S/E428R | K186E/W286S/K418S | ++ |
| 379/380 | K186A/V242T/W286S/T317Q/K359N/K418L/E428R | K186A/V242T/W286S/K359N/K418L | ++ |
| 381/382 | T317Q/K418L/E428R | K418L | ++ |
| 383/384 | K186A/V242P/F283V/W286S/T317Q/K359R/K418S/E428R | K186A/V242P/F283V/W286S/K359R/K418S | ++ |
| 385/386 | K186A/E277Q/T317Q/K359R/K418S/E428R | K186A/E277Q/K359R/K418S | + |
| 387/388 | V242Q/F283R/W286S/T317Q/E428R | V242Q/F283R/W286S | + |
| 389/390 | Q205K/T317Q/K418S/E428R | Q205K/K418S | + |
| 391/392 | T30C/F297W/T317Q/E428R | T30C/F297W | + |
| 393/394 | F283L/T317Q/K359R/K418S/E428R | F283L/K359R/K418S | + |
| 395/396 | K186E/W286S/T317Q/K418L/E428R | K186E/W286S/K418L | + |
| 397/398 | T317Q/K418T/E428R | K418T | + |
| 399/400 | Q205K/V242T/W286S/T317Q/K359R/K418S/E428R | Q205K/V242T/W286S/K359R/K418S | + |
| 401/402 | K186E/Q205K/T317Q/K359N/K418T/E428R | K186E/Q205K/K359N/K418T | + |
| 403/404 | T317Q/K418S/E428R | K418S | + |
| 405/406 | K186E/V242T/F283S/W286S/T317Q/K418S/E428R | K186E/V242T/F283S/W286S/K418S | + |
| 407/408 | T317Q/K359R/K418S/E428R | K359R/K418S | + |
| 409/410 | V242T/W286S/T317Q/K418S/E428R | V242T/W286S/K418S | + |
| 411/412 | K186E/T317Q/E428R | K186E | + |
| 413/414 | V230L/T317Q/E428R | V230L | + |
| 415/416 | T33V/F297W/T317Q/E428R | T33V/F297W | + |
| 417/418 | K186E/Q205K/T317Q/E428R | K186E/Q205K | + |
| 419/420 | K186A/F283L/T317Q/K359R/K418S/E428R | K186A/F283L/K359R/K418S | + |
| 421/422 | K186E/T317Q/K418L/E428R | K186E/K418L | + |

TABLE 13.2-continued

| Activity FIOP Relative to SEQ ID NO: 138 | | | |
|---|---|---|---|
| SEQ ID NO: (nt/aa) | Amino Acid Differences (Relative to SEQ ID NO: 2) | Amino Acid Differences (Relative to SEQ ID NO: 138) | Activity FIOP Conversion Relative to SEQ ID NO: 138 |
| 423/424 | K186E/E277Q/T317Q/K359R/K418S/E428R | K186E/E277Q/K359R/K418S | + |
| 425/426 | Q205K/V242T/F283R/T317Q/K359R/K418L/E428R | Q205K/V242T/F283R/K359R/K418L | + |
| 427/428 | K186E/T317Q/K418T/E428R | K186E/K418T | + |
| 429/430 | T33V/T317Q/Y375W/E389Q/E428R | T33V/Y375W/E389Q | + |
| 431/432 | T33R/V230L/T317Q/E428R | T33R/V230L | + |
| 433/434 | I196E/V242T/F283V/W286S/T317Q/K359R/K418T/E428R | I196E/V242T/F283V/W286S/K359R/K418T | + |
| 435/436 | K186E/V242T/F283L/T317Q/K359R/K418S/E428R | K186E/V242T/F283L/K359R/K418S | + |
| 437/438 | K186E/T317Q/K359R/E428R | K186E/K359R | + |
| 439/440 | T33V/I196V/T317Q/E428R | T33V/I196V | + |
| 441/442 | T33R/T317Q/Y375W/E389Q/E428R | T33R/Y375W/E389Q | + |
| 443/444 | K186A/E277Q/T317Q/K418S/E428R | K186A/E277Q/K418S | + |
| 445/446 | K186A/V242T/F283L/W286S/T317Q/K418L/E428R | K186A/V242T/F283L/W286S/K418L | + |
| 447/448 | V242T/T317Q/E428R | V242T | + |
| 449/450 | T33V/I196V/F297W/E301F/T317Q/E428R | T33V/I196V/F297W/E301F | + |
| 451/452 | Q205K/K237Y/V242P/F283L/W286S/T317Q/K359R/E428R | Q205K/K237Y/V242P/F283L/W286S/K359R | + |
| 453/454 | K186A/Q205K/F283L/T317Q/K359R/K418T/E428R | K186A/Q205K/F283L/K359R/K418T | + |
| 455/456 | T33V/T317Q/E389Q/E428R | T33V/E389Q | + |
| 457/458 | K186A/I196E/V242T/F283L/W286S/T317Q/K359N/K418T/E428R | K186A/I196E/V242T/F283L/W286S/K359N/K418T | + |

Levels of increased activity were determined relative to the reference polypeptide of SEQ ID NO: 138 and defined as follows: "+" from 1.01 to 1.36 (first 50%), "++" > 1.36 (next 30%), "+++" > 1.50 (top 20%)

Example 14

Improvements Over SEQ ID NO: 318 in DNA Ligase Activity

HTP Screening for Improved dsDNA Ligase Variants

SEQ ID NO: 318 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 14.1.

Ligation reactions were performed in 96-well format 200 μL BIORAD PCR plates. Reactions included Insert, adapter and reaction buffer described in Table 14.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 14.1. The quenched reactions were followed by Capillary electrophoresis (CE) sample preparation described in Table 14.1.

TABLE 14.1

| All lysis, purification, reaction, quench, and analytical properties |
|---|
| Lysis conditions: Lysis buffer - 50 mM Tris-HCl buffer, pH 7.5, 0.1 g/L lysozyme; Lysis buffer volume - 400 μL; Lysate pre-treatment - Lysates were heat-treated at 41° C. and processed as described in Example 2. The heat-treated HTP crude enzymes were used in reactions. |
| Reaction conditions: Insert - 1 nM SEQ ID: 1185 / SEQ ID: 1186, prepared as described in Example 5; Adapter - 200 nM SEQ ID: 1217/SEQ ID: 1218, prepared as described in Example 6; Reaction buffer - 66 mM Tris-HCl, pH 7.5, 10 mM Magnesium chloride, 1 mM ATP; Lysate dilution - None; Reaction temperature - 23° C.; Reaction time - 30 min |
| Quench conditions: Quench solution and volume - Reactions were quenched by addition of 5 uL of 50 mM EDTA, followed by Capillary electrophoresis (CE) sample preparation described in Example 7 |
| Analytical conditions: Instrument - capillary electrophoresis (CE) ABI 3500xl Genetic Analyzer - see Example 7 |

Activity relative to SEQ ID NO: 318 (Activity FIOP) was calculated as the fold-improvement of conversion of the variant divided by the conversion observed in the reaction with SEQ ID NO: 318 (where the conversion may be set as the average of replicates or else the highest single sample as appropriate). Conversion was calculated as double-ligated product peak areas over the total of the unligated insert, single ligated, and double-ligated product peak areas. The results are shown in Table 14.2.

TABLE 14.2

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 459/460 | F283L/W286S/T317Q/K363R/K418S/E428R | K363R | +++ |
| 461/462 | G63R/F283L/W286S/T317Q/K418S/E428R | G63R | +++ |
| 463/464 | F283L/W286S/T317Q/E389K/K418S/E428R | E389K | +++ |
| 465/466 | F283L/W286S/T317Q/S381R/K418S/E428R | S381R | +++ |
| 467/468 | F283L/W286S/T317Q/E389R/K418S/E428R | E389R | +++ |
| 469/470 | I197R/F283L/W286S/T317Q/K418S/E428R | I197R | +++ |
| 471/472 | F283L/W286S/T317Q/K359R/K418S/E428R | K359R | +++ |
| 473/474 | F283L/W286S/T317Q/S381K/K418S/E428R | S381K | +++ |
| 475/476 | N102K/F283L/W286S/T317Q/K418S/E428R | N102K | +++ |
| 477/478 | R165K/F283L/W286S/T317Q/K418S/E428R | R165K | +++ |
| 479/480 | F283L/W286S/T317Q/D388K/K418S/E428R | D388K | ++ |
| 481/482 | F283L/W286S/T317Q/S414R/K418S/E428R | S414R | ++ |
| 483/484 | F283L/W286S/T317Q/F337R/K418S/E428R | F337R | ++ |
| 485/486 | K164R/F283L/W286S/T317Q/K418S/E428R | K164R | ++ |
| 487/488 | F283L/W286S/T317Q/S416K/K418S/E428R | S416K | ++ |
| 489/490 | G101R/F283L/W286S/T317Q/K418S/E428R | G101R | ++ |
| 491/492 | F283L/W286S/T317Q/T415K/K418S/E428R | T415K | + |
| 493/494 | F283L/W286S/T317Q/K418S/S423R/E428R | S423R | + |
| 495/496 | F283L/W286S/T317Q/N364R/K418S/E428R | N364R | + |
| 497/498 | L73P/F283L/W286S/T317Q/K418S/E428R | L73P | +++ |
| 499/500 | E50I/F283L/W286S/T317Q/K418S/E428R | E50I | +++ |
| 501/502 | K71L/F283L/W286S/T317Q/K418S/E428R | K71L | +++ |
| 503/504 | F283L/W286S/T317Q/D388Y/K418S/T419G/E428R | D388Y/T419G | +++ |
| 505/506 | E50G/F283L/W286S/T317Q/K418S/E428R | E50G | ++ |
| 507/508 | F283L/W286S/T317Q/E357K/K418S/E428R | E357K | ++ |
| 509/510 | F283L/W286S/T317Q/A396H/K418S/E428R | A396H | + |
| 511/512 | I68Y/F283L/W286S/T317Q/K418S/E428R | I68Y | + |
| 513/514 | D76F/F283L/W286S/T317Q/K418S/E428R | D76F | + |
| 515/516 | K71P/F283L/W286S/T317Q/K418S/E428R | K71P | + |
| 517/518 | K14V/F283L/W286S/T317Q/K418S/E428R | K14V | + |
| 519/520 | F271G/F283L/W286S/T317Q/K418S/E428R | F271G | + |
| 521/522 | I68A/F283L/W286S/T317Q/K418S/E428R | I68A | + |
| 523/524 | I68M/F283L/W286S/T317Q/K418S/E428R | I68M | + |

TABLE 14.2-continued

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 525/526 | F283L/W286S/T317Q/E360P/K418S/E428R | E360P | + |
| 527/528 | E266M/F283L/W286S/T317Q/K418S/E428R | E266M | +++ |
| 529/530 | A208D/F283L/W286S/T317Q/K418S/E428R | A208D | +++ |
| 531/532 | P74S/F283L/W286S/T317Q/K418S/E428R | P74S | ++ |
| 533/534 | R263T/F283L/W286S/T317Q/K418S/E428R | R263T | ++ |
| 535/536 | I264C/F283L/W286S/T317Q/K418S/E428R | I264C | ++ |
| 537/538 | T13R/F283L/W286S/T317Q/K418S/E428R | T13R | ++ |
| 539/540 | R263L/F283L/W286S/T317Q/K418S/E428R | R263L | ++ |
| 541/542 | F283L/W286S/T317Q/E360M/K418S/E428R | E360M | ++ |
| 543/544 | F283L/W286S/T317Q/N378T/K418S/E428R | N378T | ++ |
| 545/546 | D76H/F283L/W286S/T317Q/K418S/E428R | D76H | ++ |
| 547/548 | T13G/F283L/W286S/T317Q/K418S/E428R | T13G | ++ |
| 549/550 | D76R/F283L/W286S/T317Q/K418S/E428R | D76R | ++ |
| 551/552 | E50T/F283L/W286S/T317Q/K418S/E428R | E50T | ++ |
| 553/554 | F283L/W286S/T317Q/V372Q/K418S/E428R | V372Q | ++ |
| 555/556 | E50S/F283L/W286S/T317Q/K418S/E428R | E50S | ++ |
| 557/558 | F283L/W286S/S300G/T317Q/K418S/E428R | S300G | ++ |
| 559/560 | L73T/F283L/W286S/T317Q/K418S/E428R | L73T | ++ |
| 561/562 | F283L/W286S/D294L/T317Q/K418S/E428R | D294L | ++ |
| 563/564 | F283L/W286S/T317Q/V372N/K418S/E428R | V372N | + |
| 565/566 | D76N/F283L/W286S/T317Q/K418S/E428R | D76N | + |
| 567/568 | F283L/W286S/W290L/T317Q/K418S/E428R | W290L | + |
| 569/570 | F283L/W286S/T317Q/R397L/K418S/E428R | R397L | + |
| 571/572 | D76G/F283L/W286S/T317Q/K418S/E428R | D76G | + |
| 573/574 | Y95L/F283L/W286S/T317Q/K418S/E428R | Y95L | + |
| 575/576 | A258L/F283L/W286S/T317Q/K418S/E428R | A258L | + |
| 577/578 | K161V/F283L/W286S/T317Q/K418S/E428R | K161V | + |
| 579/580 | V212M/F283L/W286S/T317Q/K418S/E428R | V212M | + |
| 581/582 | T198V/F283L/W286S/T317Q/K418S/E428R | T198V | + |
| 583/584 | K138L/F283L/W286S/T317Q/K418S/E428R | K138L | + |
| 585/586 | Q18D/F283L/W286S/T317Q/K418S/E428R | Q18D | + |
| 587/588 | Q18S/F283L/W286S/T317Q/K418S/E428R | Q18S | + |
| 589/590 | F283L/W286S/T317Q/K404S/K418S/E428R | K404S | + |
| 591/592 | R273G/F283L/W286S/T317Q/K418S/E428R | R273G | + |
| 593/594 | Q117G/F283L/W286S/T317Q/K418S/E428R | Q117G | + |

TABLE 14.2-continued

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 595/596 | D240E/F283L/W286S/T317Q/K418S/E428R | D240E | + |
| 597/598 | I68S/F283L/W286S/T317Q/K418S/E428R | I68S | + |
| 599/600 | L73C/F283L/W286S/T317Q/K418S/E428R | L73C | + |
| 601/602 | K69T/F283L/W286S/T317Q/K418S/E428R | K69T | + |
| 603/604 | Q278E/F283L/W286S/T317Q/K418S/E428R | Q278E | + |
| 605/606 | F283L/W286S/T317Q/E360H/K418S/E428R | E360H | + |
| 607/608 | T198D/F283L/W286S/T317Q/K418S/E428R | T198D | + |
| 609/610 | F283L/W286S/S300T/T317Q/K418S/E428R | S300T | + |
| 611/612 | K161R/F283L/W286S/T317Q/K418S/E428R | K161R | + |
| 613/614 | L73K/F283L/W286S/T317Q/K418S/E428R | L73K | + |
| 615/616 | F283L/W286S/E289V/T317Q/K418S/E428R | E289V | + |
| 617/618 | D82R/F283L/W286S/T317Q/K418S/E428R | D82R | + |
| 619/620 | F283L/W286S/T317Q/D328R/K418S/E428R | D328R | + |

Levels of increased activity were determined relative to the reference polypeptide of SEQ ID NO: 318 and defined as follows: "+" 1.00 to 1.42 (first 50%), "++" > 1.42 (next 30%), "+++" > 1.90 (top 20%)

Example 15

Improvements Over SEQ ID NO: 318 in DNA Ligase Activity, Thermostability and Solubility as Determined by % Conversion of Double-Ligated Product HTP Screening for Improved dsDNA Ligase Variants SEQ ID NO: 318 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 15.1.

Ligation reactions were performed in 96-well format 200 μL BIORAD PCR plates. Reactions included Insert, adapter and reaction buffer described in Table 15.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 15.1. The quenched reactions were followed by Capillary electrophoresis (CE) sample preparation described in Table 15.1.

TABLE 15.1

| All lysis, purification, reaction, quench, and analytical properties |
|---|
| Lysis conditions: Lysis buffer - 50 mM Tris-HCl buffer, pH 7.5, 0.1 g/L lysozyme; Lysis buffer volume - 400 μL; Lysate pre-treatment - Lysates were heat-treated at 46° C. and processed as described in Example 2. The heat-treated HTP crude enzymes were used in reactions. |
| Reaction conditions: Insert - 1 nM SEQ ID: 1185 / SEQ ID: 1186 or 1 nM SEQ ID: 1209/SEQ ID: 1210, prepared as described in Example 5; Adapter - 200 nM SEQ ID: 1217/SEQ ID: 1218, prepared as described in Example 6; Reaction buffer - 66 mM Tris-HCl, pH 7.5, 10 mM Magnesium chloride, 1 mM ATP; Lysate dilution - None; Reaction temperature - 23° C.; Reaction time - 30 min |
| Quench conditions: Quench solution and volume - Reactions were quenched by addition of 5 uL of 50 mM EDTA, followed by Capillary electrophoresis (CE) sample preparation described in Example 7 |
| Analytical conditions: Instrument - capillary electrophoresis (CE) ABI 3500xl Genetic Analyzer - see Example 7 |

Activity relative to SEQ ID NO: 318 (Activity FIOP) was calculated as the fold-improvement of conversion of the variant divided by the conversion observed in the reaction with SEQ ID NO: 318 (where the conversion may be set as the average of replicates or else the highest single sample as appropriate). Conversion was calculated as double-ligated product peak areas over the total of the unligated insert, single ligated, and double-ligated product peak areas. The results are shown in Table 15.2.

TABLE 15.2

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 621/622 | I61T/K186A/F283L/W286S/T317Q/S417D/K418S/E428R | I61T/K186A/S417D | +++ |
| 623/624 | K186A/F283L/W286S/T317Q/A370C/S417L/K418S/E428R | K186A/A370C/S417L | +++ |
| 625/626 | Q267Y/F283L/W286S/T317Q/K418S/E428R | Q267Y | +++ |
| 627/628 | I61T/F283L/W286S/T317Q/A370C/K418S/E428R | I61T/A370C | +++ |
| 629/630 | K186A/Q267Y/F283L/W286S/T317Q/A370C/S417L/K418S/E428R | K186A/Q267Y/A370C/S417L | +++ |
| 631/632 | I61T/K186C/F283L/W286S/T317Q/K418S/E428R | I61T/K186C | +++ |
| 633/634 | F283L/W286S/T317Q/A370C/S417D/K418S/E428R | A370C/S417D | +++ |
| 635/636 | F283L/W286S/T317Q/S417D/K418S/E428R | S417D | +++ |
| 637/638 | I61T/F283L/W286S/T317Q/A370C/1382V/K418S/E428R | I61T/A370C/1382V | +++ |
| 639/640 | I61T/K186A/Q267Y/F283L/W286S/T317Q/A370C/S417D/K418S/E428R | I61T/K186A/Q267Y/A370C/S417D | +++ |
| 641/642 | I61T/F283L/W286S/T317Q/K418S/E428R | I61T | +++ |
| 643/644 | Q267Y/F283L/W286S/T317Q/A370C/S417D/K418S/E428R | Q267Y/A370C/S417D | +++ |
| 645/646 | Q267Y/F283L/W286S/T317Q/A370C/K418S/E428R | Q267Y/A370C | +++ |
| 647/648 | I61T/F283L/W286S/T317Q/S417L/K418S/E428R | I61T/S417L | +++ |
| 649/650 | I61T/K186H/K237R/Q267Y/F283L/W286S/T317Q/A370C/K418S/E428R | I61T/K186H/K237R/Q267Y/A370C | +++ |
| 651/652 | I61T/K237R/F283L/W286S/T317Q/A370C/S417L/K418S/E428R | I61T/K237R/A370C/S417L | +++ |
| 653/654 | F283L/W286S/T317Q/A370C/S417L/K418S/E428R | A370C/S417L | ++ |
| 655/656 | F283L/W286S/T317Q/A370C/K418S/E428R | A370C | ++ |
| 657/658 | K186E/F283L/W286S/T317Q/A370C/K418S/E428R | K186E/A370C | ++ |
| 659/660 | I61T/K186E/Q267Y/F283L/W286S/T317Q/S417D/K418S/E428R | I61T/K186E/Q267Y/S417D | ++ |
| 661/662 | I61T/K186C/F283L/W286S/T317Q/A370C/1382V/K418S/E428R | I61T/K186C/A370C/I382V | ++ |
| 663/664 | F283L/W286S/T317Q/A370C/I382V/S417D/K418S/E428R | A370C/I382V/S417D | ++ |
| 665/666 | I61T/K186C/Q267Y/F283L/W286S/T317Q/S417D/K418S/E428R | I61T/K186C/Q267Y/S417D | ++ |
| 667/668 | I61T/K186C/F283L/W286S/T317Q/A370C/K418S/E428R | I61T/K186C/A370C | ++ |
| 669/670 | K237R/Q267Y/F283L/W286S/T317Q/A370C/S417D/K418S/E428R | K237R/Q267Y/A370C/S417D | ++ |
| 671/672 | I61T/K186E/F283L/W286S/T317Q/S417D/K418S/E428R | I61T/K186E/S417D | ++ |
| 673/674 | I61T/K186H/F283L/W286S/T317Q/K418S/E428R | I61T/K186H | ++ |
| 675/676 | I61T/K186C/F283L/W286S/T317Q/1382V/K418S/E428R | I61T/K186C/I382V | ++ |
| 677/678 | I61T/K186H/F283L/W286S/T317Q/A370C/K418S/E428R | I61T/K186H/A370C | ++ |
| 679/680 | I61T/Q267Y/F283L/W286S/T317Q/K418S/E428R | I61T/Q267Y | ++ |
| 681/682 | I61T/Q267Y/F283L/W286S/T317Q/S417L/K418S/E428R | I61T/Q267Y/S417L | ++ |
| 683/684 | I61T/K237R/Q267Y/F283L/W286S/T317Q/I382V/K418S/E428R | I61T/K237R/Q267Y/I382V | ++ |
| 685/686 | K186H/F283L/W286S/T317Q/A370C/I382V/K418S/E428R | K186H/A370C/I382V | ++ |

TABLE 15.2-continued

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 687/688 | K237R/Q267Y/F283L/W286S/T317Q/A370C/K418S/E428R | K237R/Q267Y/A370C | ++ |
| 689/690 | K186H/F283L/W286S/T317Q/A370C/S417D/K418S/E428R | K186H/A370C/S417D | + |
| 691/692 | I61T/K186V/Q267Y/F283L/W286S/T317Q/A370C/K418S/E428R | I61T/K186V/Q267Y/A370C | + |
| 693/694 | Q267Y/F283L/W286S/T317Q/A370C/S417L/K418S/E428R | Q267Y/A370C/S417L | + |
| 695/696 | I61T/K186V/F283L/W286S/T317Q/A370C/K418S/E428R | I61T/K186V/A370C | + |
| 697/698 | K186H/K237R/Q267Y/F283L/W286S/T317Q/A370C/K418S/E428R | K186H/K237R/Q267Y/A370C | + |
| 699/700 | I61T/K186E/Q267Y/F283L/W286S/T317Q/K418S/E428R | I61T/K186E/Q267Y | + |
| 701/702 | I61T/K186C/K237R/F283L/W286S/T317Q/K418S/E428R | I61T/K186C/K237R | + |
| 703/704 | I61T/K186H/K237R/F283L/W286S/T317Q/K418S/E428R | I61T/K186H/K237R | + |
| 705/706 | I61T/K186C/F283L/W286S/T317Q/S417L/K418S/E428R | I61T/K186C/S417L | + |
| 707/708 | K186H/F283L/W286S/T317Q/K418S/E428R | K186H | + |
| 709/710 | K186A/Q267Y/F283L/W286S/T317Q/K418S/E428R | K186A/Q267Y | + |
| 711/712 | K186C/F283L/W286S/T317Q/A370C/K418S/E428R | K186C/A370C | + |
| 713/714 | I61T/K186C/K237R/Q267Y/F283L/W286S/T317Q/A370C/K418S/E428R | I61T/K186C/K237R/Q267Y/A370C | + |
| 715/716 | K186E/Q267Y/F283L/W286S/T317Q/K418S/E428R | K186E/Q267Y | + |
| 717/718 | K237R/F283L/W286S/T317Q/A370C/S417L/K418S/E428R | K237R/A370C/S417L | + |
| 719/720 | K186H/F283L/W286S/T317Q/A370C/K418S/E428R | K186H/A370C | + |
| 721/722 | V242Q/F283L/W286S/T317Q/S414Q/K418S/E428R | V242Q/S414Q | +++ |
| 723/724 | F283L/W286S/T317Q/S414T/K418S/E428R | S414T | +++ |
| 725/726 | F283L/W286S/T317Q/S414Q/K418S/E428R | S414Q | +++ |
| 727/728 | Y162W/F283L/W286S/T317Q/S414Q/K418S/E428R | Y162W/S414Q | +++ |
| 729/730 | Y162W/F283L/W286S/T317Q/S414V/K418S/E428R | Y162W/S414V | +++ |
| 731/732 | Q267D/F283L/W286S/T317Q/S414T/K418S/E428R | Q267D/S414T | +++ |
| 733/734 | F283L/W286S/T317Q/S414V/K418S/E428R | S414V | +++ |
| 735/736 | Q267D/F283L/W286S/T317Q/S414Q/K418S/E428R | Q267D/S414Q | ++ |
| 737/738 | F283L/W286S/T317Q/S414A/K418S/E428R | S414A | ++ |
| 739/740 | Y162W/F283L/W286S/T317Q/S414L/K418S/E428R | Y162W/S414L | ++ |
| 741/742 | L105S/F283L/W286S/T317Q/S414T/K418S/E428R | L105S/S414T | ++ |
| 743/744 | Y162W/V242Q/F283L/W286S/T317Q/S414T/K418S/E428R | Y162W/V242Q/S414T | + |
| 745/746 | R97G/Y162W/F283L/W286S/T317Q/S414Q/K418S/E428R | R97G/Y162W/S414Q | + |
| 747/748 | L105S/Y162W/Q267D/F283L/W286S/T317Q/S414V/K418S/E428R | L105S/Y162W/Q267D/S414V | + |
| 749/750 | F283L/W286S/T317Q/E356V/K418S/E428R | E356V | +++ |
| 751/752 | R273A/F283L/W286S/T317Q/K418S/E428R | R273A | +++ |
| 753/754 | F283L/W286S/T317Q/E357P/K418S/E428R | E357P | +++ |
| 755/756 | K14G/F283L/W286S/T317Q/K418S/E428R | K14G | +++ |

TABLE 15.2-continued

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 757/758 | K14S/F283L/W286S/T317Q/K418S/E428R | K14S | +++ |
| 759/760 | F283L/W286S/T317Q/A396C/K418S/E428R | A396C | ++ |
| 761/762 | D240R/F283L/W286S/T317Q/K418S/E428R | D240R | ++ |
| 763/764 | F283L/W286S/T317Q/V392K/K418S/E428R | V392K | ++ |
| 765/766 | R273S/F283L/W286S/T317Q/K418S/E428R | R273S | ++ |
| 767/768 | D106V/F283L/W286S/T317Q/K418S/E428R | D106V | ++ |
| 769/770 | F283L/W286S/F308S/T317Q/K418S/E428R | F308S | ++ |
| 771/772 | F283L/W286S/F308L/T317Q/K418S/E428R | F308L | ++ |
| 773/774 | F283L/W286S/E306I/T317Q/K418S/E428R | E306I | ++ |
| 775/776 | N96A/F283L/W286S/T317Q/K418S/E428R | N96A | ++ |
| 777/778 | F283L/W286S/T317Q/R397K/K418S/E428R | R397K | ++ |
| 779/780 | R263Q/F283L/W286S/T317Q/K418S/E428R | R263Q | ++ |
| 781/782 | E282T/F283L/W286S/T317Q/K418S/E428R | E282T | ++ |
| 783/784 | K138R/F283L/W286S/T317Q/K418S/E428R | K138R | ++ |
| 785/786 | A258S/F283L/W286S/T317Q/K418S/E428R | A258S | ++ |
| 787/788 | D76L/F283L/W286S/T317Q/K418S/E428R | D76L | ++ |
| 789/790 | K14T/F283L/W286S/T317Q/K418S/E428R | K14T | ++ |
| 791/792 | F283L/W286S/E289S/T317Q/K418S/E428R | E289S | ++ |
| 793/794 | D240G/F283L/W286S/T317Q/K418S/E428R | D240G | ++ |
| 795/796 | D106S/F283L/W286S/T317Q/K418S/E428R | D106S | ++ |
| 797/798 | Q117S/F283L/W286S/T317Q/K418S/E428R | Q117S | ++ |
| 799/800 | F283L/W286S/T317Q/E357S/K418S/E428R | E357S | ++ |
| 801/802 | N96G/F283L/W286S/T317Q/K418S/E428R | N96G | + |
| 803/804 | S113T/F283L/W286S/T317Q/K418S/E428R | S113T | + |
| 805/806 | K71G/F283L/W286S/T317Q/K418S/E428R | K71G | + |
| 807/808 | E282V/F283L/W286S/T317Q/K418S/E428R | E282V | + |
| 809/810 | Q117V/F283L/W286S/T317Q/K418S/E428R | Q117V | + |
| 811/812 | E282M/F283L/W286S/T317Q/K418S/E428R | E282M | + |
| 813/814 | A258V/F283L/W286S/T317Q/K418S/E428R | A258V | + |
| 815/816 | F283L/W286S/H309G/T317Q/K418S/E428R | H309G | + |
| 817/818 | F283L/W286S/E306K/T317Q/K418S/E428R | E306K | + |
| 819/820 | F283L/W286S/F308K/T317Q/K418S/E428R | F308K | + |
| 821/822 | F283L/W286S/T317Q/E357R/K418S/E428R | E357R | + |
| 823/824 | V212S/F283L/W286S/T317Q/K418S/E428R | V212S | + |
| 825/826 | Q18N/F283L/W286S/T317Q/K418S/E428R | Q18N | + |

TABLE 15.2-continued

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 827/828 | S113A/F283L/W286S/T317Q/K418S/E428R | S113A | + |
| 829/830 | F283L/W286S/E306S/T317Q/K418S/E428R | E306S | + |
| 831/832 | V212F/F283L/W286S/T317Q/K418S/E428R | V212F | + |
| 833/834 | T198N/F283L/W286S/T317Q/K418S/E428R | T198N | + |
| 835/836 | V110R/F283L/W286S/T317Q/K418S/E428R | V110R | + |
| 837/838 | D240K/F283L/W286S/T317Q/K418S/E428R | D240K | + |
| 839/840 | T198L/F283L/W286S/T317Q/K418S/E428R | T198L | + |
| 841/842 | K71R/F283L/W286S/T317Q/K418S/E428R | K71R | + |
| 843/844 | F283L/W286S/T317Q/E357V/K418S/E428R | E357V | + |
| 845/846 | T198R/F283L/W286S/T317Q/K418S/E428R | T198R | + |
| 847/848 | F271A/F283L/W286S/T317Q/K418S/E428R | F271A | + |
| 849/850 | E282Y/F283L/W286S/T317Q/K418S/E428R | E282Y | + |
| 851/852 | V212G/F283L/W286S/T317Q/K418S/E428R | V212G | + |
| 853/854 | Y95V/F283L/W286S/T317Q/K418S/E428R | Y95V | + |
| 855/856 | D37S/F283L/W286S/T317Q/K418S/E428R | D37S | + |
| 857/858 | I68V/F283L/W286S/T317Q/K418S/E428R | I68V | + |
| 859/860 | D240S/F283L/W286S/T317Q/K418S/E428R | D240S | + |
| 861/862 | Q117Y/F283L/W286S/T317Q/K418S/E428R | Q117Y | + |
| 863/864 | T201S/F283L/W286S/T317Q/K418S/E428R | T201S | + |
| 865/866 | F271N/F283L/W286S/T317Q/K418S/E428R | F271N | + |
| 867/868 | D240Q/F283L/W286S/T317Q/K418S/E428R | D240Q | + |
| 869/870 | F283L/W286S/E289L/T317Q/K418S/E428R | E289L | + |
| 871/872 | V212W/F283L/W286S/T317Q/K418S/E428R | V212W | + |
| 873/874 | T198W/F283L/W286S/T317Q/K418S/E428R | T198W | + |
| 875/876 | F283L/W286S/T317Q/E357H/K418S/E428R | E357H | + |
| 877/878 | A208F/F283L/W286S/T317Q/K418S/E428R | A208F | + |
| 879/880 | E282L/F283L/W286S/T317Q/K418S/E428R | E282L | + |
| 881/882 | F283L/W286S/E306V/T317Q/K418S/E428R | E306V | + |
| 883/884 | F283L/P284D/W286S/T317Q/K418S/E428R | P284D | + |
| 885/886 | N96T/F283L/W286S/T317Q/K418S/E428R | N96T | + |
| 887/888 | E266T/F283L/W286S/T317Q/K418S/E428R | E266T | + |
| 889/890 | F283L/W286S/T317Q/E374S/K418S/E428R | E374S | + |
| 891/892 | Y95R/F283L/W286S/T317Q/K418S/E428R | Y95R | + |

TABLE 15.2-continued

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 893/894 | F283L/W286S/H309R/T317Q/K418S/E428R | H309R | + |
| 895/896 | L73W/F283L/W286S/T317Q/K418S/E428R | L73W | + |
| 897/898 | F283L/W286S/T317Q/R397M/K418S/E428R | R397M | + |
| 899/900 | F283L/W286S/E289A/T317Q/K418S/E428R | E289A | + |
| 901/902 | F283L/W286S/G295K/T317Q/K418S/E428R | G295K | + |
| 903/904 | D106L/F283L/W286S/T317Q/K418S/E428R | D106L | + |
| | I61T/K186A/F283L/W286S/T317Q/S417D/K418S/E428R | I61T/K186A/S417D | |

Levels of increased activity were determined relative to the reference polypeptide of SEQ ID NO: 318 and defined as follows: "+" 1.00 to 1.16 (first 50%), "++" > 1.16 (next 30%), "+++" > 1.40 (top 20%)

Example 16

Improvements Over SEQ ID NO: 318 in DNA Ligase Activity, Thermostability and Solubility as Determined by % Conversion of Double-Ligated Product HIP Screening for Improved dsDNA Ligase Variants SEQ ID NO: 318 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HIP and prepared as described in Table 16.1.

Ligation reactions were performed in 96-well format 200 μL BIORAD PCR plates. Reactions included insert, adapter and reaction buffer described in Table 16.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was ten added into the wells to initiate the reaction. The reaction plate was heat-sealed with a peelable aluminum seal and incubated in a thermocycler at the indicated temperature and reaction time, ten held at 4° C. until the reaction was quenched. Reaction and quench details are specified in Table 16.1. The quenched reactions were followed by Capillary electrophoresis (CE) sample preparation described in Table 16.1.

TABLE 16.1

| All lysis, purification, reaction, quench, and analytical properties |
|---|
| Lysis conditions: Lysis buffer - 50 mM Tris-HCl buffer, pH 7.5, 0.1 g/L lysozyme; Lysis buffer volume - 400 μL; Lysate pre-treatment - Lysates were heat-treated at 45° C. and processed as described in Example 2. The heat-treated HTP crude enzymes were used in reactions. |
| Reaction conditions: Insert - 1 nM SEQ ID: 1185 / SEQ ID: 1186, prepared as described in Example 5; Adapter - 200 nM SEQ ID: 1217 / SEQ ID: 1218, prepared as described in Example 6; Reaction buffer - 66 mM Tris-HCl, pH 7.5, 10 mM Magnesium chloride, 1 mM ATP, 1 mM DTT; Lysate dilution - None; Reaction temperature - 23° C.; Reaction time - 30 min |
| Quench conditions: Quench solution and volume - Reactions were quenched by addition of 5 uL of 50 mM EDTA, followed by Capillary electrophoresis (CE) sample preparation as described in Example 7 |
| Analytical conditions: Instrument - capillary electrophoresis (CE) ABI 3500xl Genetic Analyzer - see Example 7 |

Activity relative to SEQ ID NO: 318 (Activity FIOP) was calculated as the fold-improvement of conversion of the variant divided by the conversion observed in the reaction with SEQ ID NO: 318 (where the conversion may be set as the average of replicates or else the highest single sample as appropriate). Conversion was calculated as double-ligated product peak areas over the total of the unligated insert, single ligated, and double-ligated product peak areas. The results are shown in Table 16.2.

TABLE 16.2

| Activity FIOP Relative to SEQ ID NO: 318 | | | |
|---|---|---|---|
| SEQ ID NO: (nt/aa) | Amino Acid Differences (Relative to SEQ ID NO: 2) | Amino Acid Differences (Relative to SEQ ID NO: 318) | Activity FIOP Conversion Relative to SEQ ID NO: 318 |
| 905/906 | Y95A/F283L/W286S/T317Q/K418S/E428R | Y95A | +++ |
| 907/908 | F283L/W286S/T317Q/E374A/K418S/E428R | E374A | +++ |
| 909/910 | L88V/F283L/W286S/T317Q/K418S/E428R | L88V | +++ |
| 911/912 | N96V/F283L/W286S/T317Q/K418S/E428R | N96V | ++ |
| 913/914 | F271S/F283L/W286S/T317Q/K418S/E428R | F271S | ++ |
| 915/916 | D44S/F283L/W286S/T317Q/K418S/E428R | D44S | ++ |
| 917/918 | A208H/F283L/W286S/T317Q/K418S/E428R | A208H | ++ |
| 919/920 | R263G/F283L/W286S/T317Q/K418S/E428R | R263G | ++ |
| 921/922 | M12A/F283L/W286S/T317Q/K418S/E428R | M12A | + |
| 923/924 | T201L/F283L/W286S/T317Q/K418S/E428R | T201L | + |
| 925/926 | T198A/F283L/W286S/T317Q/K418S/E428R | T198A | + |
| 927/928 | T198K/F283L/W286S/T317Q/K418S/E428R | T198K | + |
| 929/930 | E282G/F283L/W286S/T317Q/K418S/E428R | E282G | + |
| 931/932 | F283L/W286S/T317Q/M390E/K418S/E428R | M390E | + |
| 933/934 | I264A/F283L/W286S/T317Q/K418S/E428R | I264A | + |
| 935/936 | L73V/F283L/W286S/T317Q/K418S/E428R | L73V | + |

Levels of increased activity were determined relative to the reference polypeptide of SEQ ID NO: 318 and defined as follows: "+" 1.00 to 1.05 (first 50%), "++" > 1.05 (next 30%), "+++" > 1.07 (top 20%)

Example 17

Improvements Over SEQ ID NO: 722 in DNA Ligase Activity and Substrate Bias as Determined by % Conversion of Double-Ligated Product

HTP Screening for Improved dsDNA Ligase Variants

SEQ ID NO: 722 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 17.1.

Ligation reactions were performed in 96-well format 200 μL BIORAD PCR plates. Reactions included insert, adapter and reaction buffer described in Table 17.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 17.1. The quenched reactions were followed by Capillary electrophoresis (CE) sample preparation described in Table 17.1.

TABLE 17.1

| All lysis, purification, reaction, quench, and analytical properties |
|---|
| Lysis conditions: Lysis buffer - 50 mM Tris-HCl buffer, pH 7.5, 0.1 g/L lysozyme; Lysis buffer volume - 400 μL; Lysate pre-treatment - Lysates were heat-treated at 47° C. and processed as described in Example 2. The heat-treated HTP crude enzymes were used in reactions. |
| Reaction conditions: Insert - 1 nM SEQ ID: 1193 / SEQ ID: 1194 or 1 nM SEQ ID: 1195 / SEQ ID: 1196, prepared as described in Example 5; Adapter - 200 nM SEQ ID: 1217 / SEQ ID: 1218, prepared as described in Example 6; Reaction buffer - 66 mM Tris-HCl, pH 7.5, 10 mM Magnesium chloride, 1 mM ATP; Lysate dilution - 2 times; Reaction temperature - 23° C.; Reaction time - 10 or 30 min |
| Quench conditions: Quench solution and volume - Reactions were quenched by addition of 5 uL of 50 mM EDTA, followed by Capillary electrophoresis (CE) sample preparation as described in Example 7 |
| Analytical conditions: Instrument - capillary electrophoresis (CE) ABI 3500xl Genetic Analyzer - see Example 7 |

Activity relative to SEQ ID NO: 722 (Activity FIOP) was calculated as the fold-improvement of conversion of the variant divided by the conversion observed in the reaction with SEQ ID NO: 722 (where the conversion may be set as the average of replicates or else the highest single sample as appropriate). Conversion was calculated as double-ligated product peak areas over the total of the unligated insert, single ligated, and double-ligated product peak areas. The results are shown in Table 17.2.

TABLE 17.2

| Activity FIOP Relative to SEQ ID NO: 722 | | | |
|---|---|---|---|
| SEQ ID NO: (nt/aa) | Amino Acid Differences (Relative to SEQ ID NO: 2) | Amino Acid Differences (Relative to SEQ ID NO: 722) | Activity FIOP Conversion Relative to SEQ ID NO: 722 |
| 937/938 | G63R/V242Q/F283L/W286S/T317Q/S414Q/K418S/E428R | G63R | ++ |
| 939/940 | G63R/N96T/V242Q/F283L/W286S/T317Q/A370C/S414Q/K418S/E428R | G63R/N96T/A370C | ++ |
| 941/942 | V242Q/F283L/W286S/T317Q/E389K/S414Q/K418S/E428R | E389K | ++ |
| 943/944 | T13R/V242Q/Q267Y/F283L/W286S/T317Q/K363R/E389K/S414Q/K418S/E428R | T13R/Q267Y/K363R/E389K | ++ |
| 945/946 | T13R/K186H/V242Q/F283L/W286S/T317Q/E389K/S414Q/K418S/E428R | T13R/K186H/E389K | ++ |
| 947/948 | E50T/V242Q/Q267Y/F283L/W286S/T317Q/K363R/A370C/E389K/S414Q/K418S/E428R | E50T/Q267Y/K363R/A370C/E389K | + |
| 949/950 | V242Q/F283L/W286S/T317Q/K363R/A370C/S414Q/K418S/E428R | K363R/A370C | + |
| 951/952 | N96T/V242Q/F283L/W286S/T317Q/A370C/S414Q/K418S/E428R | N96T/A370C | + |
| 953/954 | I61T/G63R/V212W/V242Q/F283L/W286S/T317Q/S414Q/K418S/E428R | I61T/G63R/V212W | + |
| 955/956 | G11D/V242Q/F283L/W286S/Q305K/T317Q/S414Q/K418S/E428R | G11D/Q305K | + |
| 957/958 | G11D/V242Q/F283L/W286S/T317Q/S414Q/K418S/E428R | G11D | + |
| 959/960 | E428R | Q242V/L283F/S286W/Q317T/Q414S/S418K | +++ |
| 961/962 | V242Q/F283L/W286S/T317Q/M323S/S414Q/K418S/E428R | M323S | +++ |
| 963/964 | V242Q/F283L/W286S/T317Q/K334L/S414Q/K418S/E428R | K334L | +++ |
| 965/966 | V242Q/F283L/W286S/T317Q/I339Y/S414Q/K418S/E428R | I339Y | +++ |
| 967/968 | V242Q/F283L/W286S/T317Q/E356V/S414Q/K418S/E428R | E356V | +++ |
| 969/970 | V242Q/F283L/W286S/T317Q/G384V/S414Q/K418S/E428R | G384V | +++ |
| 971/972 | V242Q/F283L/W286S/T317Q/I408C/S414Q/K418S/E428R | I408C | +++ |
| 973/974 | K67R/V242Q/F283L/W286S/T317Q/S414Q/K418S/E428R | K67R | +++ |
| 975/976 | V242Q/F283L/W286S/T317Q/V392R/S414Q/K418S/E428R | V392R | +++ |
| 977/978 | A104K/V242Q/F283L/W286S/T317Q/S414Q/K418S/E428R | A104K | +++ |
| 979/980 | V242Q/F283L/W286S/T317Q/F355S/S414Q/K418S/E428R | F355S | +++ |
| 981/982 | L159Q/V242Q/F283L/W286S/T317Q/S414Q/K418S/E428R | L159Q | +++ |
| 983/984 | L155R/V242Q/F283L/W286S/T317Q/S414Q/K418S/E428R | L155R | +++ |
| 985/986 | V242Q/F283L/W286S/T317Q/V367L/S414Q/K418S/E428R | V367L | +++ |
| 987/988 | S31R/V242Q/F283L/W286S/T317Q/S414Q/K418S/E428R | S31R | +++ |
| 989/990 | Q231P/V242Q/F283L/W286S/T317Q/S414Q/K418S/E428R | Q231P | +++ |
| 991/992 | E36Y/V242Q/F283L/W286S/T317Q/S414Q/K418S/E428R | E36Y | ++ |
| 993/994 | E150T/V242Q/F283L/W286S/T317Q/S414Q/K418S/E428R | E150T | ++ |
| 995/996 | D239V/V242Q/F283L/W286S/T317Q/S414Q/K418S/E428R | D239V | ++ |
| 997/998 | A103V/V242Q/F283L/W286S/T317Q/S414Q/K418S/E428R | A103V | ++ |
| 999/1000 | V242Q/F283L/W286S/T317Q/E356A/S414Q/K418S/E428R | E356A | ++ |
| 1001/1002 | G63F/V242Q/F283L/W286S/T317Q/S414Q/K418S/E428R | G63F | ++ |
| 1003/1004 | K125T/V242Q/F283L/W286S/T317Q/S414Q/K418S/E428R | K125T | ++ |

TABLE 17.2-continued

| Activity FIOP Relative to SEQ ID NO: 722 | | | |
|---|---|---|---|
| SEQ ID NO: (nt/aa) | Amino Acid Differences (Relative to SEQ ID NO: 2) | Amino Acid Differences (Relative to SEQ ID NO: 722) | Activity FIOP Conversion Relative to SEQ ID NO: 722 |
| 1005/1006 | V242Q/F283L/W286S/T317Q/V367C/ S414Q/K418S/E428R | V367C | ++ |
| 1007/1008 | A228I/V242Q/F283L/W286S/T317Q/ S414Q/K418S/E428R | A228I | ++ |
| 1009/1010 | D37S/V242Q/F283L/W286S/T317Q/ S414Q/K418S/E428R | D37S | ++ |
| 1011/1012 | D37G/V242Q/F283L/W286S/T317Q/ S414Q/K418S/E428R | D37G | ++ |
| 1013/1014 | D239M/V242Q/F283L/W286S/T317Q/ S414Q/K418S/E428R | D239M | ++ |
| 1015/1016 | D239W/V242Q/F283L/W286S/T317Q/ S414Q/K418S/E428R | D239W | ++ |
| 1017/1018 | D239Q/V242Q/F283L/W286S/T317Q/ S414Q/K418S/E428R | D239Q | ++ |
| 1019/1020 | L189C/V242Q/F283L/W286S/T317Q/ S414Q/K418S/E428R | L189C | ++ |
| 1021/1022 | D239S/V242Q/F283L/W286S/T317Q/ S414Q/K418S/E428R | D239S | ++ |
| 1023/1024 | D239T/V242Q/F283L/W286S/T317Q/ S414Q/K418S/E428R | D239T | ++ |
| 1025/1026 | C177G/V242Q/F283L/W286S/T317Q/ S414Q/K418S/E428R | C177G | ++ |
| 1027/1028 | D239P/V242Q/F283L/W286S/T317Q/ S414Q/K418S/E428R | D239P | ++ |
| 1029/1030 | D37N/V242Q/F283L/W286S/T317Q/ S414Q/K418S/E428R | D37N | + |
| 1031/1032 | V242Q/F283L/W286S/T317Q/S414Q/ K418S/K422N/E428R | K422N | + |
| 1033/1034 | A228S/V242Q/F283L/W286S/T317Q/ S414Q/K418S/E428R | A228S | + |
| 1035/1036 | K125R/V242Q/F283L/W286S/T317Q/ S414Q/K418S/E428R | K125R | + |
| 1037/1038 | Q128C/V242Q/F283L/W286S/T317Q/ S414Q/K418S/E428R | Q128C | + |
| 1039/1040 | L189T/V242Q/F283L/W286S/T317Q/ S414Q/K418S/E428R | L189T | + |
| 1041/1042 | V242Q/F283L/W286S/T317Q/E356W/ S414Q/K418S/E428R | E356W | + |
| 1043/1044 | I220V/V242Q/F283L/W286S/T317Q/ S414Q/K418S/E428R | I220V | + |
| 1045/1046 | V242Q/F283L/W286S/T317Q/I408V/ S414Q/K418S/E428R | I408V | + |
| 1047/1048 | V242Q/F283L/W286S/T317Q/V392S/ S414Q/K418S/E428R | V392S | + |
| 1049/1050 | D130T/V242Q/F283L/W286S/T317Q/ S414Q/K418S/E428R | D130T | + |
| 1051/1052 | A228M/V242Q/F283L/W286S/T317Q/ S414Q/K418S/E428R | A228M | + |
| 1053/1054 | Y56P/V242Q/F283L/W286S/T317Q/ S414Q/K418S/E428R | Y56P | + |
| 1055/1056 | A228E/V242Q/F283L/W286S/T317Q/ S414Q/K418S/E428R | A228E | + |
| 1057/1058 | K190R/V242Q/F283L/W286S/T317Q/ S414Q/K418S/E428R | K190R | + |
| 1059/1060 | V242Q/F283L/W286S/T317Q/V392I/ S414Q/K418S/E428R | V392I | + |
| 1061/1062 | A156C/V242Q/F283L/W286S/T317Q/ S414Q/K418S/E428R | A156C | + |
| 1063/1064 | K232R/V242Q/F283L/W286S/T317Q/ S414Q/K418S/E428R | K232R | + |
| 1065/1066 | E150F/V242Q/F283L/W286S/T317Q/ S414Q/K418S/E428R | E150F | + |
| 1067/1068 | E150C/V242Q/F283L/W286S/T317Q/ S414Q/K418S/E428R | E150C | + |
| 1069/1070 | D239N/V242Q/F283L/W286S/T317Q/ S414Q/K418S/E428R | D239N | + |
| 1071/1072 | V242Q/F283L/W286S/T317Q/V392L/ S414Q/K418S/E428R | V392L | + |
| 1073/1074 | V242Q/F283L/W286S/T317Q/S414Q/ K418S/S423T/E428R | S423T | + |

TABLE 17.2-continued

| Activity FIOP Relative to SEQ ID NO: 722 | | | |
|---|---|---|---|
| SEQ ID NO: (nt/aa) | Amino Acid Differences (Relative to SEQ ID NO: 2) | Amino Acid Differences (Relative to SEQ ID NO: 722) | Activity FIOP Conversion Relative to SEQ ID NO: 722 |
| 1075/1076 | A34L/V242Q/F283L/W286S/T317Q/S414Q/K418S/E428R | A34L | + |
| 1077/1078 | L99I/V242Q/F283L/W286S/T317Q/S414Q/K418S/E428R | L99I | + |
| 1079/1080 | V242Q/F283L/W286S/T317Q/G384C/S414Q/K418S/E428R | G384C | + |
| 1081/1082 | D59E/V242Q/F283L/W286S/T317Q/S414Q/K418S/E428R | D59E | + |
| 1083/1084 | V242Q/F283L/W286S/T317Q/K334R/S414Q/K418S/E428R | K334R | + |
| 1085/1086 | L60Y/V242Q/F283L/W286S/T317Q/S414Q/K418S/E428R | L60Y | + |
| 1087/1088 | L99G/V242Q/F283L/W286S/T317Q/S414Q/K418S/E428R | L99G | + |
| 1089/1090 | A34R/V242Q/F283L/W286S/T317Q/S414Q/K418S/E428R | A34R | + |
| 1091/1092 | D37L/V242Q/F283L/W286S/T317Q/S414Q/K418S/E428R | D37L | + |
| 1093/1094 | V242Q/F283L/W286S/T317Q/V392C/S414Q/K418S/E428R | V392C | + |
| 1095/1096 | V242Q/F283L/W286S/T317Q/S414Q/K418S/K421R/E428R | K421R | + |
| 1097/1098 | K195R/V242Q/F283L/W286S/T317Q/S414Q/K418S/E428R | K195R | + |

Levels of increased activity were determined relative to the reference polypeptide of SEQ ID NO: 318 and defined as follows: "+" 1.00 to 1.53 (first 50%), "++" > 1.53 (next 30%), "+++" > 2.14 (top 20%)

Example 18

Improvements Over SEQ ID NO: 938 in DNA Ligase Activity and Substrate Bias as Determined by % Conversion of Double-Ligated Product

HTP Screening for Improved dsDNA Ligase Variants

SEQ ID NO: 938 was selected as the parent DNA ligase enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 18.1.

Ligation reactions were performed in 96-well format 200 μL BIORAD PCR plates. Reactions included insert, adapter and reaction buffer described in Table 18.1. The reactions were set up as follows: (i) all reaction components, except for dsDNA ligase, were pre-mixed in a single solution, and 20 μL of this solution was aliquoted into each well of the 96-well plates (ii) 5 μL of dsDNA ligase solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 18.1. The quenched reactions were followed by Capillary electrophoresis (CE) sample preparation described in Table 18.1.

TABLE 18.1

| All lysis, purification, reaction, quench, and analytical properties |
|---|
| Lysis conditions: Lysis buffer - 50 mM Tris-HCl buffer, pH 7.5, 0.1 g/L lysozyme; Lysis buffer volume - 400 μL; Lysate pre-treatment - Lysates were heat-treated at 47° C. and processed as described in Example 2. The heat-treated HTP crude enzymes were used in reactions. |
| Reaction conditions: Insert - 1 nM SEQ ID: 1195/SEQ ID: 1196, prepared as described in Example 5; Adapter - 200 nM SEQ ID: 1217 / SEQ ID: 1218, prepared as described in Example 6; Reaction buffer - 66 mM Tris-HCl, pH 7.5, 10 mM Magnesium chloride, 1 mM ATP; Lysate dilution - 4 times; Reaction temperature - 23° C.; Reaction time - 30 min |
| Quench conditions: Quench solution and volume - Reactions were quenched by addition of 5 uL of 50 mM EDTA, followed by Capillary electrophoresis (CE) sample preparation described in Example 7 |
| Analytical conditions: Instrument - capillary electrophoresis (CE) ABI 3500xl Genetic Analyzer - see Example 7 |

Activity relative to SEQ ID NO: 938 (Activity FIOP) was calculated as the fold-improvement of conversion of the variant divided by the conversion observed in the reaction with SEQ ID NO: 938 (where the conversion may be set as the average of replicates or else the highest single sample as appropriate). Conversion was calculated as double-ligated product peak areas over the total of the unligated insert, single ligated, and double-ligated product peak areas. The results are shown in Table 18.2.

TABLE 18.2

| Activity FIOP Relative to SEQ ID NO: 938 | | | |
|---|---|---|---|
| SEQ ID NO: (nt/aa) | Amino Acid Differences (Relative to SEQ ID NO: 2) | Amino Acid Differences (Relative to SEQ ID NO: 938) | Activity FIOP Conversion Relative to SEQ ID NO: 938 |
| 1099/1100 | G63R/V242Q/F283L/W286S/F308L/T317Q/E357S/M390E/S414Q/K418S/E428R | F308L/E357S/M390E | +++ |
| 1101/1102 | G63R/P74S/D76L/T201S/V242Q/F283L/W286S/F308L/T317Q/E357P/S414Q/K418S/E428R | P74S/D76L/T201S/F308L/E357P | +++ |
| 1103/1104 | I61T/G63R/P74S/D76L/K186A/T201S/V242Q/F283L/W286S/F308L/H309R/T317Q/E357P/M390E/S414Q/K418S/E428R | I61T/P74S/D76L/K186A/T201S/F308L/H309R/E357P/M390E | +++ |
| 1105/1106 | K14G/G63R/T201S/D240R/V242Q/F283L/W286S/E289S/T317Q/E357P/S414Q/K418S/E428R | K14G/T201S/D240R/E289S/E357P | +++ |
| 1107/1108 | G63R/V242Q/F283L/W286S/F308S/T317Q/S414Q/T415I/K418S/E428R | F308S/T415I | +++ |
| 1109/1110 | G63R/D76L/V242Q/F283L/W286S/T317Q/E357S/A396C/S414Q/K418S/E428R | D76L/E357S/A396C | +++ |
| 1111/1112 | G63R/V242Q/R263L/F283L/W286S/F308L/T317Q/A396C/S414Q/K418S/E428R | R263L/F308L/A396C | +++ |
| 1113/1114 | I61T/G63R/D76L/N96A/D240R/V242Q/F283L/W286S/F308L/H309R/T317Q/S414Q/K418S/E428R | I61T/D76L/N96A/D24OR/F308L/H309R | +++ |
| 1115/1116 | K14S/G63R/V242Q/F283L/W286S/E306I/T317Q/S414Q/T415I/K418S/E428R | K14S/E306I/T415I | ++ |
| 1117/1118 | K14S/G63R/L73W/D106S/V242Q/F283L/W286S/T317Q/S414Q/T415I/K418S/E428R | K14S/L73W/D106S/T415I | ++ |
| 1119/1120 | M12A/K14G/G63R/V242Q/A258S/R263Q/F283L/W286S/E289S/F308L/H309R/T317Q/A396C/S414Q/K418S/E428R | M12A/K14G/A258S/R263Q/E289S/F308L/H309R/A396C | ++ |
| 1121/1122 | G63R/P74S/D76L/Q117V/V242Q/F283L/W286S/H309R/T317Q/E357S/S414Q/K418S/E428R | P74S/D76L/Q117V/H309R/E357S | ++ |
| 1123/1124 | K14T/G63R/V242Q/A258S/R263Q/F283L/W286S/T317Q/E357S/A396C/S414Q/K418S/E428R | K14T/A258S/R263Q/E357S/A396C | ++ |
| 1125/1126 | K14S/G63R/N96G/D106S/V242Q/F283L/W286S/E306I/T317Q/S414Q/K418S/E428R | K14S/N96G/D106S/E306I | ++ |
| 1127/1128 | K14S/G63R/D106S/V242Q/F283L/W286S/T317Q/S414Q/K418S/E428R | K14S/D106S | ++ |
| 1129/1130 | M12A/K14G/G63R/V242Q/F283L/W286S/F308L/H309R/T317Q/S414Q/K418S/E428R | M12A/K14G/F308L/H309R | ++ |
| 1131/1132 | K14G/G63R/V242Q/F283L/W286S/T317Q/E357S/M390E/S414Q/K418S/E428R | K14G/E357S/M390E | ++ |
| 1133/1134 | K14G/G63R/Q117V/V242Q/A258S/F283L/W286S/H309R/T317Q/E357S/S414Q/K418S/E428R | K14G/Q117V/A258S/H309R/E357S | ++ |
| 1135/1136 | G63R/V242Q/F283L/W286S/T317Q/M390E/S414Q/K418S/E428R | M390E | ++ |
| 1137/1138 | G63R/D240R/V242Q/R273S/F283L/W286S/T317Q/E357P/M390E/S414Q/K418S/E428R | D240R/R273S/E357P/M390E | ++ |
| 1139/1140 | I61T/G63R/D76L/K186V/T201S/V242Q/F283L/W286S/F308L/H309R/T317Q/S414Q/K418S/E428R | I61T/D76L/K186V/T201S/F308L/H309R | ++ |
| 1141/1142 | K14G/G63R/V242Q/F283L/W286S/T317Q/A396C/S414Q/K418S/E428R | K14G/A396C | + |
| 1143/1144 | G63R/V242Q/F283L/W286S/H309R/T317Q/S414Q/K418S/E428R | H309R | + |

TABLE 18.2-continued

| Activity FIOP Relative to SEQ ID NO: 938 | | | |
|---|---|---|---|
| SEQ ID NO: (nt/aa) | Amino Acid Differences (Relative to SEQ ID NO: 2) | Amino Acid Differences (Relative to SEQ ID NO: 938) | Activity FIOP Conversion Relative to SEQ ID NO: 938 |
| 1145/1146 | K14S/G63R/V242Q/F283L/W286S/T317Q/S414Q/K418S/E428R | K14S | + |
| 1147/1148 | G63R/D106V/V242Q/F283L/W286S/E306I/F308S/T317Q/S414Q/K418S/E428R | D106V/E306I/F308S | + |
| 1149/1150 | K14S/G63R/D240S/V242Q/F283L/W286S/E306I/F308S/T317Q/S414Q/K418S/E428R | K14S/D240S/E306I/F308S | + |
| 1151/1152 | M12I/K14G/G63R/K186V/V242Q/F283L/W286S/T317Q/E357S/S414Q/K418S/E428R | M12I/K14G/K186V/E357S | + |
| 1153/1154 | G63R/V242Q/F283L/W286S/H309R/T317Q/M390E/S414Q/K418S/E428R | H309R/M390E | + |
| 1155/1156 | K14S/G63R/V242Q/F283L/W286S/E306I/T317Q/S414Q/K418S/E428R | K14S/E306I | + |
| 1157/1158 | K14T/G63R/V242Q/F283L/W286S/T317Q/S414Q/K418S/E428R | K14T | + |
| 1159/1160 | K14S/G63R/D76R/V242Q/F283L/W286S/F308S/T317Q/S414Q/K418S/E428R | K14S/D76R/F308S | + |
| 1161/1162 | G63R/Q117V/A208D/V242Q/A258S/R263Q/F283L/W286S/E289S/F308L/H309R/T317Q/S414Q/K418S/E428R | Q117V/A208D/A258S/R263Q/E289S/F308L/H309R | + |
| 1163/1164 | K14S/G63R/L73W/D106S/V242Q/F283L/W286S/T317Q/S414Q/K418S/E428R | K14S/L73W/D106S | + |
| 1165/1166 | G63R/D76L/A208D/V242Q/R263Q/F283L/W286S/T317Q/S414Q/K418S/E428R | D76L/A208D/R263Q | + |
| 1167/1168 | G63R/V242Q/F283L/W286S/T317Q/E357S/S414Q/K418S/E428R | E357S | + |
| 1169/1170 | K14S/G63R/V242Q/F283L/W286S/F308S/T317Q/S414Q/K418S/E428R | K14S/F308S | + |
| 1171/1172 | G63R/V242Q/R263L/F283L/W286S/T317Q/S414Q/K418S/E428R | R263L | + |
| 1173/1174 | G63R/D76L/V242Q/F283L/W286S/T317Q/S414Q/K418S/E428R | D76L | + |
| 1175/1176 | K14S/G63R/V242Q/F283L/W286S/S300G/F308S/T317Q/S414Q/T415I/K418S/E428R | K14S/S300G/F308S/T415I | + |
| 1177/1178 | G63R/D240Y/V242Q/F283L/W286S/T317Q/S414Q/K418S/E428R | D240Y | + |
| 1179/1180 | T33M/G63R/V242Q/F283L/W286S/T317Q/E357S/M390E/S414Q/K418S/E428R | T33M/E357S/M390E | + |
| 1181/1182 | K14G/G63R/D76L/V242Q/R273S/F283L/W286S/T317Q/S414Q/K418S/E428R | K14G/D76L/R273S | + |
| 1183/1184 | G63R/P74S/V242Q/F283L/W286S/T317Q/S414Q/K418S/E428R | P74S | + |

Levels of increased activity were determined relative to the reference polypeptide of SEQ ID NO: 318 and defined as follows: "+" 1.00 to 1.21 (first 50%), "++" > 1.21 (next 30%), "+++" > 1.42 (top 20%)

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

SEQUENCE LISTING (1254 sequences)

SEQ ID NO: 1 - DNA, 1311 bp, synthetic construct
  misc_feature 1..1311: note = DNA ligase from Bacillus phage JL taxonomy ID 1296655
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 2 - protein, 437 aa, synthetic construct
  REGION 1..437: note = DNA ligase from Bacillus phage JL taxonomy ID 1296655
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 3 - DNA, 1839 bp, synthetic construct
  misc_feature 1..1839: note = Homolog of Bacillus phage JL DNA ligase
  source 1..1839: mol_type = other DNA
atgcaccatcatcatcatcatggcggtagcggcatgccgtttaaaccagttgcggaagctttcgcaagcatggagcgcattacctctcgtacacagctgacgctcttactgacccgcctgtttaaaagtacgcctcctggcgcaatcggtatcgtggtgtatctgattcaaggaaagttaggtcccgattggaaaggcttgccagaacttggtgtcggcgaaaaactgctggtaaaagcgattgccttggcctacaaagcgactgaggagcgtgttgaacgcctgtataaatcagttggagacttaggttccgtggctgaacgtcttagccgcgaataccgttcgcgtgcagcccgcgcggtcaccctcgaagctttcatggcaggcggcggcgaagcgttgaccgtacgtcgcgtgtataacactctctaccgtatcgcgatggctcagggtgaaggtagtcgcgatattaagttacgccttttggccggcttactcgccgatgcggaacccgtcgaggccaagtatatcgtgcgttttgttgagggccgtcttcgcgtgggtgttggtgacgcgaccgtgttggatgcacttgcgatggcctttggtggaggagcacatgcacgcccagtcattgaacgtgcgtacaatttacgtgctgacctcggctatatcgcggaagtagtagctcgtgaaggcgtggatgcattgcgcggcgtgaaacctcaggtcggtgttccaattcgtcctatgttagcggaacgcggccgtgatcccgcggagattcttcgcaaagttggtggacgcgctgtggtggagtataaatacgacggcgaacgtgcgcaaatccacaagaaagatggtgaagtctatatttatagccgccgcttggagaacatcacgcgtatgttcccagatgtcgttgaaatggcacgtaaaggcttaaaagcgggcgaagcaattgtagagggtgaaatcgtggcggtagaccccgacaattacgaaattcagccttttcaggtgctcatgcaacgcaaacgcaagcatgatatccaccgtgttatgcgcgaagttccagtcgcagtgttcttgtttgatgctttgtatgttgatggcgaagatcttacatccaaacctttacccgagcgccgtcgtcgcctcaaagaaattgtggtagaaactccattgtggcgtcttgcggagtcgatcgaaacctcagatcccgaggagttgtggacgttcttcctcaaggcgattgaagaaggtgctgaaggagtcatggtgaaagcagttcatcgtgactctgtatacaccgctggcgttcgcggttggctttgggtgaaattaaaacgcgactacaagagcgaaatgatggataccgtggacttagtcgttgttggcgcgttctatggtcgtggcaaacgcggtggcaaattgtcgagtcttttaatggcagcgtatgatcctgatcgcgacgtctttccaacggtctgcaaagtggcgaccggctttacggatgaagaactcgatcgtatgaacgagatgcttaagaaacacattattcctcgcaaacatccacgtgtagaaagccgtatcgaacccgacgtgtgggtagagccagcattggtggcggaaattttgggagcagaacttaccctttcccccatgcacacctgttgtctcaatacagttcgccctggtgtcggcatctctatccgttttcctcgctttattcgctggcgcgatgataaaagcccagaagacgctacgacgactcatgagttattggagatgtacaaacgtcagttacgtcgtgtggaagaacccgctgaacaggtg

SEQ ID NO: 4 - protein, 613 aa, synthetic construct
  REGION 1..613: note = Homolog of Bacillus phage JL DNA ligase
MHHHHHHGGSGMPFKPVAEAFASMERITSRTQLTLLLTRLFKSTPPGAIGIVVYLIQGKLGPDWKGLPELGVGEKLLVKAIALAYKATEERVERLYKSVGDLGSVAERLSREYRSRAARAVTLEAFMAGGGEALTVRRVYNTLYRIAMAQGEGSRDIKLRLLAGLLADAEPVEAKYIVRFVEGRLRVGVGDATVLDALAMAFGGGAHARPVIERAYNLRADLGYIAEVVAREGVDALRGVKPQVGVPIRPMLAERGRDPAEILRKVGGRAVVEYKYDGERAQIHKKDGEVYIYSRRLENITRMFPDVVEMARKGLKAGEAIVEGEIVAVDPDNYEIQPFQVLMQRKRKHDIHRVMREVPVAVFLFDALYVDGEDLTSKPLPERRRRLKEIVVETPLWRLAESIETSDPEELWTFFLKAIEEGAEGVMVKAVHRDSVYTAGVRGWLWVKLKRDYKSEMMDTVDLVVVGAFYGRGKRGGKLSSLLMAAYDPDRDVFPTVCKVATGFTDEELDRMNEMLKKHIIPRKHPRVESRIEPDVWVEPALVAEILGAELTLSPMHTCCLNTVRPGVGISIRFPRFIRWRDDKSPEDATTTHELLEMYKRQLRRVEEPAEQV

SEQ ID NO: 5 - DNA, 1842 bp, synthetic construct
  misc_feature 1..1842: note = Homolog of Bacillus phage JL DNA ligase
  source 1..1842: mol_type = other DNA
atgcaccatcatcatcatcatggcggtagcggcatggaaagtgatctggaattttctaacattgtgtcggttttgaaactggtagaagcgaccacccagcgtacagtcatggccaaagcacttagcagcctgttagctaagactccgccgcaagtgatcgacaaagtcatttatttcctgctgggctcattacgcccagattgggagggtgttgaacttgggttagcggagcgtttgacgttgcgcgcaatctccatggccaccggcctgcctattcgtcaggtggaagaactgtacaagaaactgggtgatgcgggagaggtagcaaaacgcgctgccgaaatcaaacgcagtaaaggcggcggtggtacgatctttgacttcattgatactggaccgaaacgtcgtctgaccattagcaaggtgtatgacacgctgatggcgatcgcgaaagcctctggcgaaggtgctcaggataccaaagttaaacttctctcgtcgctgctgaccgatgcagaacccgacgaggcgaagtacattacacgctttgtcattggccgcctccgtttaggtgtggccgatatgacgatcctggatgcgttgtcagacgctttcgatgttaatcgcgacctgctggagaaagcctaccatgtgtatccggatctcggcaagattgcgaaaaccctggcagaaggaggcgaagaagcggtcaaagccatcaaagtaactccaggtgtgccgatccaacctatgcttgcagagcgtttgtcctccccgaaggaaattctgaacaaattaggcggcgttgcgatctgcgagtttaaatatgatggtgaacgcatgcagattcacaaactgaaagacggtacggtgaagatctttagccgtcgtatggaagatatcaccaatcagtatcccgatgtcgctgaatacgcccgcgaagcaattgacgcggaggagttcattgttgaaggcgaaggagtggccattgatccggacacaggcgagtttaaaccattccaagaactcatgcatcgcaaacgcaaacacaacatcaaagaagcgattgaagaatatccgatcaatctgtacctgtttgatgtcatgtatgttaacggtcaggatctgaccgaccttccgttacctgatcgtaagaaagtactgttcagcattattaaaccgcatgagcacgttcatcatgctgattggatcatcacggacgacgcagattctctcgaaaaattctttttggatgcgattagtagtggttgtgaaggcgtgatgtgcaagagcgtgaaactgggctcagtctacgaaatgggtgcacgtggatggctgtggatcaaatataaacgcgattacaaatcggaactgagcgacaccatggatttggtagttgtgggtgccttttggggccgtggcaaacgcgccggtacttatggcgcgctgctgttagctgcgtatgatccagactccgatcagttctacaccgtgtgtaaagtcggaagcggttttacggacgaagatttaaagaaattgccgcaaatgctggaaccctataagattcctcaccgtcatccgcgcgtggtgtctaagatggagccggacatttggtttactccaggcctggtactcgaaattacaggtgccgagatcaccatgtcaccgcttcacacttgctgctcggttatgctgaaaggcgatgtaggactggcgattcgtttccctcgctttacgggtcgttaccgcaccgataaacgtccggaagatgcaaccaccgtcaaagaaatctttgagatgtattccaatcagaagaaagtgaaacttacggaccaagttcct

SEQ ID NO: 6 - protein, 614 aa, synthetic construct
  REGION 1..614: note = Homolog of Bacillus phage JL DNA ligase
MHHHHHHGGSGMESDLEFSNIVSVLKLVEATTQRTVMAKALSSLLAKTPPQVIDKVIYFLLGSLRPDWEGVELGLAERLTLRAISMATGLPIRQVEELYKKLGDAGEVAKRAAEIKRSKGGGGTIFDFIDTGPKRRLTISKVYDTLMAIAKASGEGAQDTKVKLLSSLLTDAEPDEAKYITRFVIGRLRLGVADMTILDALSDAFDVNRDLLEKAYHVYPDLGKIAKTLAEGGEEAVKAIKVTPGVPIQPMLAERLSSPKEILNKLGGVAICEFKYDGERMQIHKLKDGTVKIFSRRMEDITNQYPDVAEYAREAIDAEEFIVEGEGVAIDPDTGEFKPFQELMHRKRKHNIKEAIEEYPINLYLFDVMYVNGQDLTDLPLPDRKKVLFSIIKPHEHVHHADWIITDDADSLEKFFLDAISSGCEGVMCKSVKLGSVYEMGARGWLWIKYKRDYKSELSDTMDLVVVGAFWGRGKRAGTYGALLLAAYDPDSDQFYTVCKVGSGFTDEDLKKLPQMLEPYKIPHRHPRVVSKMEPDIWFTPGLVLEITGAEITMSPLHTCCSVMLKGDVGLAIRFPRFTGRYRTDKRPEDATTVKEIFEMYSNQKKVKLTDQVP

SEQ ID NO: 7 - DNA, 1830 bp, synthetic construct
  misc_feature 1..1830: note = Homolog of Bacillus phage JL DNA ligase
  source 1..1830: mol_type = other DNA
atgcaccatcatcatcatcatggcggtagcggcatggattttgaaattattgcacgtaccttcgacgcgctggagaagatcagcagccgcatcgccttaacgaacgctctggtggatctcttcaaacagacctcgaaagacgaagttaagattgtcgtctatcttattcaaggccgcttgtggccggattggaaaggtatgccagaaatcggagtagcggagaaactgctgattaaagccgcatctatcgccctgaatgtgaaggaagaacagatcaacaagatctacaaagaagttggcgatttggggaaagctattgagcagattaaagcgagtaaagatgcgactgcaggtacactgacctcctttttaggcgtgcaaaagaaagagaaactgtcagtgaagaagatctatgaatcgtttgttaagattgcgacggccgaaggtgaaggcagccgtgacattaaactgcgtgtcctcgccgggctgctgaaagatgctcagccgatcgaagcacgcttcattgtacgctttgtggagggtcgtcttcgcatcaatattggcgacgcgaccgttatggatgcgttatccatcgcttttactggaacggatgccaaccgtcctattattgaacgcgcgtacaatttgcgtgcagacctgggtgatatcgcggaaattctggtgaaagacggcatcaacgccctccagaatatcaccccgaaagtaggtattcccattcgcccgatgcttgcagagcgtcataacgatccaaaagtcatgctggagaaagttggcggcaaagcgtatgtggaatacaaatatgatggtgaacgcgcccagatccacaaaagtaacgacgaaatcacaattttctctcgtcgtctggagaatatcacccatcaatatccggatgtggtggaatacagccgcaaatatattaaagctaacgaagcgattgtagaaggcgaaattgtcgcaatcgatcctgacacgcgcgagttacgtccgtttcagattttgatgacccgcaaacgtaaacacgatatcacgaagatgatgaaagaagttcccgtgtcagttttcctgtttgacgccatctacgtggatgggaaagatctgaccaatttcccgttaccagaacgccgcaaatatctggagagtgtcattgctcaatcggacgacatgcagattgcgcagtacaaatatatcgataacgcggaagatctggaaaagatgttctatgaagccattagcaatggtgcagaaggagttatgattaaatccatctctgagaaaagcatctaccaagcaggcaaccgtggttggctgtggatcaaatataaacgtgattaccgctcagaaatgtcggactccgtcgatctggtggtagtaggcgcgttttatggtaaaggcaaacgtgctgggaaactgagcactattcttgttgcgggatacgatccggatgccgacgtgtttcgcaccgtctgcaaggttggtacaggctttacggatgaagaattggacaagatgaccgaagaattcaaagggtatattatcgaccataaagatccgcgtgtcattagtgagatcactcctgatgtgtggctgattccgaagaaagtggtggaggttattggcgccgaattgaccctgtctccattacacacgtgtgcgaaaggtgaaatcagcaaagaagcaggcctttcaattcgctttccgcgtttcatcaattggcgccccgataaaggtccggaagacgccaccacctgcaaagagctggtcgaaatgtaccgtatgcagctcaagcaagtagaggaggaacagaaccct

SEQ ID NO: 8 - protein, 610 aa, synthetic construct
  REGION 1..610: note = Homolog of Bacillus phage JL DNA ligase
MHHHHHHGGSGMDFEIIARTFDALEKISSRIALTNALVDLFKQTSKDEVKIVVYLIQGRLWPDWKGMPEIGVAEKLLIKAASIALNVKEEQINKIYKEVGDLGKAIEQIKASKDATAGTLTSFLGVQKKEKLSVKKIYESFVKIATAEGEGSRDIKLRVLAGLLKDAQPIEARFIVRFVEGRLRINIGDATVMDALSIAFTGTDANRPIIERAYNLRADLGDIAEILVKDGINALQNITPKVGIPIRPMLAERHNDPKVMLEKVGGKAYVEYKYDGERAQIHKSNDEITIFSRRLENITHQYPDVVEYSRKYIKANEAIVEGEIVAIDPDTRELRPFQILMTRKRKHDITKMMKEVPVSVFLFDAIYVDGKDLTNFPLPERRKYLESVIAQSDDMQIAQYKYIDNAEDLEKMFYEAISNGAEGVMIKSISEKSIYQAGNRGWLWIKYKRDYRSEMSDSVDLVVVGAFYGKGKRAGKLSTILVAGYDPDADVFRTVCKVGTGFTDEELDKMTEEFKGYIIDHKDPRVISEITPDVWLIPKKVVEVIGAELTLSPLHTCAKGEISKEAGLSIRFPRFINWRPDKGPEDATTCKELVEMYRMQLKQVEEEQNP

SEQ ID NO: 9 - DNA, 1818 bp, synthetic construct
  misc_feature 1..1818: note = Homolog of Bacillus phage JL DNA ligase
  source 1..1818: mol_type = other DNA
atgcaccatcatcatcatcatggcggtagcggcatgaaatttaaatatattgttgaaaccttcgaaaagatcgaagtgacgagcagccgcattcagattgtcgccacactgtctgcgctctttaagaaagtaatcgaggagaacaaagaaatcatcgataaagtggtgtacttcgttcaaggccgtttatggccggactggtacggttatccagagattgggatcggagaaaaaggcattattaaagcaattgctctggcggcgaatgtccgcgaacgtgaagtggaggagctgctgaaaagtttgggcgatcttggtctggttgccgaacgcctgatcgcaaagaaatcctcgcgtccgtcaggtttgttgagctttactcagacccagtcgaaagatctgaccttcgaagaagtctatgaaacgctcaaacgcattgcttttttacaaggcgaagggagtcgtgacctgaagatcaagaaactggccggtcttttaaaacgtgcgagccctaaagaggcgaaatacattgtgcgcttcgtagaaggcaaactgcgcctgggtgttggcgatgcatccatcatcgaagccattgcgtctattctgggagtgccgaaagagattgtagaacgtgcctataaccttcgcgcagacctgggcaatatcgctaagatcgcctttacccagggtcccgaagcgctcaaagcgattcgtccgcagccagggattccggttcgccctatgttagcagaacgtctgcatgatccggtcgagatcctgaagaaagtgggtggcaaaggattggctgagtataaatacgatggtgaacgcgcgcaaattcacctgacgaaagaaggcaaagtgatcatctattcacgtcgtctggaaaacatcacccattcgtacccggacgtcgtcaaatatgccaaggaaaatctgaaagcagaagaagcgattgttgaaggcgaaattgtagctgttgatccgaacactggtgaattacgcccctttcaggagcttatgcaccgccgccgcaagcatgacgttcacattgccatgaaagaatacccggtacatgtgcgtctgttcgatgcgattctggtgaatggcgaggatctgacaaacaaaccgcttttggaacgtcgtgaacgcctgatcagcattttgaaccaaaccgacgagtttcgtctggcaacgggtgaaatcgttgataccgtcgaagaattagagcgcctgttccatcaggccattgctgatggttgcgaaggcctcgtggtgaaagcgatccacaaagggtccatttatcaggcaggcgcgcgtgggtggctgtggatcaaatataaacgcgactacaagagtgagatgatcgaacctgttgatctggtcgtagtaggcgcgttctatggtcgtggacgtcgcggtggtacttttggtgccttgttaatggcagggtacgatgaggacaaagatgcctttatgacggtgtgtaaagtgggttctggctttaccgacgaagatctggctgaacttccggatctgctgaaggagtatatcatccccaataaacatccacgtgttgttagcgaaattaaaccggacgtctggattcagcctgcgttagtggccgagattattggagcggaaattacactgtcaccgatccacacctgcgccatcgataaagtcgaaaaaggtactggcttggcgattcgtttcccacgctttattaaatggcgtccggataaagggccgcaagacgctaccacctgtaaggaactcctcgaaatgtacaaacgccagcttcgccgtacggtggag

SEQ ID NO: 10 - protein, 606 aa, synthetic construct
  REGION 1..606: note = Homolog of Bacillus phage JL DNA ligase
MHHHHHHGGSGMKFKYIVETFEKIEVTSSRIQIVATLSALFKKVIEENKEIIDKVVYFVQGRLWPDWYGYPEIGIGEKGIIKAIALAANVREREVEELLKSLGDLGLVAERLIAKKSSRPSGLLSFTQTQSKDLTFEEVYETLKRIAFLQGEGSRDLKIKKLAGLLKRASPKEAKYIVRFVEGKLRLGVGDASIIEAIASILGVPKEIVERAYNLRADLGNIAKIAFTQGPEALKAIRPQPGIPVRPMLAERLHDPVEILKKVGGKGLAEYKYDGERAQIHLTKEGKVIIYSRRLENITHSYPDVVKYAKENLKAEEAIVEGEIVAVDPNTGELRPFQELMHRRRKHDVHIAMKEYPVHVRLFDAILVNGEDLTNKPLLERRERLISILNQTDEFRLATGEIVDTVEELERLFHQAIADGCEGLVVKAIHKGSIYQAGARGWLWIKYKRDYKSEMIEPVDLVVVGAFYGRGRRGGTFGALLMAGYDEDKDAFMTVCKVGSGFTDEDLAELPDLLKEYIIPNKHPRVVSEIKPDVWIQPALVAEIIGAEITLSPIHTCAIDKVEKGTGLAIRFPRFIKWRPDKGPQDATTCKELLEMYKRQLRRTVE

SEQ ID NO: 11 - DNA, 1845 bp, synthetic construct
  misc_feature 1..1845: note = Homolog of Bacillus phage JL DNA ligase
  source 1..1845: mol_type = other DNA
atgcaccatcatcatcatcatggcggtagcggcatggaatttagcattgttgcacaaaccctggatatccttgagaagacgtcgtcgaagattcagcaggctgctgccttagccctgctgttcaagaagactccgagtaacgtgatcgacaaagtagtctatattattcagggtaccttgtggccagattggaaaggccttcctgaactggggatcgcagagaaaggcgtgcagaaagccatctccatggcactgggtgtttctgaagctgaagtggaacgcgtctacaaaagcctgggagattatggcttagccgtagagcgtttgaaactgggcaagcagaataaatcagtgggtctggtcgggtttattaaatctgcaaaaggcgaagtgtacaagaaactgacggttgacgaagtctatagccaactcgtgaagatcgccatgcttcaaggtgaaggaagtcgcgatatgaaattacgtctgctgtcctcccttttggcagtagctgacccgaaagaggccaaatacattgttcgcttcattgaaggtcgtctgcgcctgggcgttggtgaagctaccatcatggatggcttggcaagcgcctttggtgcaccgcgtgatctcattgaacgcgcctataacatctatcccgacttgggtgctatcgccaaattactggcagagaaaggcgtggtggaactgaagaatattaaaccgacaccaggcattccgttacgtcctatgcttgctgaacgtgcaagtgatccgaccgagatcctcaacaaagccgggattcctgccctcgctgagttcaaatacgatggtgaacgcgcacagatccataagaaaggcgaccgcatttggatcttttcacgtcgtcttgaagaaatcacgaatcagtatccggatgtcgtcgaaatggccttgaaacgcatcaaagctgaagaggccattgttgaaggcgagatcatcgcaattgatccggaaaccggagaatttcgccccttccaagagttaatgcaccgtaaacgcaagaaagacattcatgaggccctcaaagaatacccagtggtggtgcgcctctttgactgcttgtatgttgatgggattgatatgactcttaagattttaccggaacgtcgtgaaatgctccgcaagattattgatgaaagcgaggagttcaaattggctgaaggtatgatcgtcaacaacacagccgaattagagaccttcttccttaaagcagtagaagcaggttgtgaaggcttagttgtaaaatctttgggacgtgactcggtgtatcaggctggcgttcgcggttggctttggatcaaatacaaacgtgattataaaagcgaaatgactgatacggtggaccttgtcgtcgtaggagcatttcacggccgcggtaaacgtgctggtacctatggtgccttgctcctcgccgcctacgatccggaatcagacacgtttaagaccgtgtgcaaagttggcacaggctttaccgatgaggagttagcagaacttcccaagaaattggaaccgtaccgtctcccgcataaacaccaccgcgtggattcggacattgaagcagatgtgtggtttgaaccagctgttgttatggaagtaactggagccgagctcaccttaagccctttgcatacgtgttgtcgtggcatggtcaaacaaggcgtgggcatttccattcgcttcccacgctttgtgcgttggcgcccggacaaaagtccgaaagaaatcaccaccacgaaagagatcttagagatgtattatcgtcagcttcgcaaagtttctcagacaacaacgggtgtcggcgaagaacgt

SEQ ID NO: 12 - protein, 615 aa, synthetic construct
  REGION 1..615: note = Homolog of Bacillus phage JL DNA ligase
MHHHHHHGGSGMEFSIVAQTLDILEKTSSKIQQAAALALLFKKTPSNVIDKVVYIIQGTLWPDWKGLPELGIAEKGVQKAISMALGVSEAEVERVYKSLGDYGLAVERLKLGKQNKSVGLVGFIKSAKGEVYKKLTVDEVYSQLVKIAMLQGEGSRDMKLRLLSSLLAVADPKEAKYIVRFIEGRLRLGVGEATIMDGLASAFGAPRDLIERAYNIYPDLGAIAKLLAEKGVVELKNIKPTPGIPLRPMLAERASDPTEILNKAGIPALAEFKYDGERAQIHKKGDRIWIFSRRLEEITNQYPDVVEMALKRIKAEEAIVEGEIIAIDPETGEFRPFQELMHRKRKKDIHEALKEYPVVVRLFDCLYVDGIDMTLKILPERREMLRKIIDESEEFKLAEGMIVNNTAELETFFLKAVEAGCEGLVVKSLGRDSVYQAGVRGWLWIKYKRDYKSEMTDTVDLVVVGAFHGRGKRAGTYGALLLAAYDPESDTFKTVCKVGTGFTDEELAELPKKLEPYRLPHKHHRVDSDIEADVWFEPAVVMEVTGAELTLSPLHTCCRGMVKQGVGISIRFPRFVRWRPDKSPKEITTTKEILEMYYRQLRKVSQTTTGVGEER

SEQ ID NO: 13 - DNA, 1782 bp, synthetic construct
  misc_feature 1..1782: note = Homolog of Bacillus phage JL DNA ligase
  source 1..1782: mol_type = other DNA
atgcaccatcatcatcatcatggcggtagcggcatgcagtttggtgaactggcgaaagtgttggctgccgttgaaagcacgacccaacgcactaccatggtcaaactgctgacgtcccttttcaagaaggcaaaaccggaggagatcgataagattgtgtattttattttaggcgacttacgtccaccatgggaaggagtagaattgggtgtcgcggagaaactctgcatccgtgccatcagtaaagcgaccggcctttctgcagcagaattggaagggtggtacaagaaatcaggcgatgttggtgaagtagctcgccgcgctttagccgccggcaaacgtccgacactccttgcattcgctcagcagaaacctctcgaagtggccgaggtgtatgatacccttctcaaagttgcaaaagccgccggtgaaggcgcacaagacttgaaagtgtcgctcttaagcagcttattttcgcgcgctagtccggaggaagccaagtacattgcacgtttcgttgtcgggaaattacgtcttggtgtggctgatatgacgttgattgaagcactctccgaagcctttggcgtctctaaagaaggtcttgagcgcgcctaccatgtttatccggatttgggacgcttagcacgtcacgtggctgaaggccgtcccctcgaagagatcaagattactccgggcgtccctgtcttgccaatgttagcacagcgtttgagtagcgcctcggaaatccttgctaaacttggtggtaccgccatttgtgagtataaatatgacggagaacgcgctcagatccatttacgcgaagggtccgtgaaaattttttcacgtcgcctcgaagatattacgcacgcatacccggacgttgccaaagccgtgaaagaagcagtaaaagctcgcgaggccatcttggaaggcgaaattgtagctgttgatccggatacaggcgaaatgttacccttccaagaattgatgcatcgtaaacgcaaacacgacgtagcagaggccatggaagcatatccggccgtgctttacctcttcgacctcctttatgtggatggtgaggatttaaccacccagccgttgatctaccgtcgtcttcgcttgagcgaagttgttgaagaaggcggcgatgtctacatcgcaaagtgggggatgtttgatggagctgaagacgtggacctcttctttcatgaagccgtctctttaggtactgagggcctcatttgcaaatcacctacgagcacctatgaaatgggtgcacgcggttggaactggattaagtataaacgtgattatcgctcggagatgatcgatacagtggatttggtagtagttggtgcttttcatggccgtggcaaacgtgcaggtttatatggagccttcttattagctgcttacgacccgtccaccgacatgttctacacggtgtgtaaagttggcagcggctttactgatgccgatttgcgccgcatgtatgacatgcttcagccgctcaagattcctcaccgtcatccacgtgtcgtcagtaagatgcaaccggatgtgtggtttgttccacaggtggtgattgaagttatcggtgccgaaatcacactttcaccgttgcatacctgctgcattggagcagtgaaacccggcgtgggattagccattcgctttccgcgctttaccggtcgttaccgcacggataaacgtcccgaagatgcaaccaccactaaagagcttgtcgagatgtatcaacgccagaagaaagtaccaacgacg

SEQ ID NO: 14 - protein, 594 aa, synthetic construct
  REGION 1..594: note = Homolog of Bacillus phage JL DNA ligase
MHHHHHHGGSGMQFGELAKVLAAVESTTQRTTMVKLLTSLFKKAKPEEIDKIVYFILGDLRPPWEGVELGVAEKLCIRAISKATGLSAAELEGWYKKSGDVGEVARRALAAGKRPTLLAFAQQKPLEVAEVYDTLLKVAKAAGEGAQDLKVSLLSSLFSRASPEEAKYIARFVVGKLRLGVADMTLIEALSEAFGVSKEGLERAYHVYPDLGRLARHVAEGRPLEEIKITPGVPVLPMLAQRLSSASEILAKLGGTAICEYKYDGERAQIHLREGSVKIFSRRLEDITHAYPDVAKAVKEAVKAREAILEGEIVAVDPDTGEMLPFQELMHRKRKHDVAEAMEAYPAVLYLFDLLYVDGEDLTTQPLIYRRLRLSEVVEEGGDVYIAKWGMFDGAEDVDLFFHEAVSLGTEGLICKSPTSTYEMGARGWNWIKYKRDYRSEMIDTVDLVVVGAFHGRGKRAGLYGAFLLAAYDPSTDMFYTVCKVGSGFTDADLRRMYDMLQPLKIPHRHPRVVSKMQPDVWFVPQVVIEVIGAEITLSPLHTCCIGAVKPGVGLAIRFPRFTGRYRTDKRPEDATTTKELVEMYQRQKKVPTT

SEQ ID NO: 15 - DNA, 1860 bp, synthetic construct
  misc_feature 1..1860: note = Homolog of Bacillus phage JL DNA ligase
  source 1..1860: mol_type = other DNA
atgcaccatcatcatcatcatggcggtagcggcatgccgatgccatttagtattttagcagaaaccttcgagaaactggaacgcactacgagccgtacccagatggtgctgtatttggttgatctgtttaagaagacccctccggaaacgatcgacaaagtcgtctacttcctgcaaggcaaactttggccggattggaaaggtctgccggaattaggagtgggcgagaagaccctcattaaagcggtttctatcgcccttcatgtaccagaacgcacagtggaagagttggctaaacgtctcggtgatttaggcttggcggtagaacgtctcaaacgcgagaaagagaaaggtgccaaagcagttgggcttttggcgtttatgaaacagccctcctcaggcgaatcgacgttaactgtggaaaaggtctatgacaccttagctcgtgtggcgcttacaacaggtgaaggaagccgcgaactcaaactcaaacttgttgcagggttgattgccgaagcgagtccgcgcgaagccaagtacatcgtgcgcttcattgaaggtcgtttgcgtttaggcgttggcgatgctaccatcatcgaggccctttcgattgtatatgcaggatctgcggcgatgaaacacgtcgtcgaacgcgcctacaacctccgtgcggacttgggtttagtggccaagattttggcaacgcagggcgttgaggcggtgaagaatattaaacctgaagtaggtatcccgattcgccccatgttagctgaacgtctcaacaacccggtggaaatccttaagaaattaggcgggcgtgcactcgtggagtataagtatgatggtgaacgcgcgcaaatccataagaaaggcgacaagatttggatctttagccgtcgcttggagaatatcaccaagatgtacccagatgtcgttgaaatggcccttaaaggcattaaagctaatgaagcgattgtggagggtgaaattgtcgcaattgatccggatactggtgaattgcgcccttttcaggaattaatgcgtcgcaaacgtaaacacgacatccatattgccatgaaagaggttccggtggcggtgtacctcttcgacatcttgtatcgtgatggcgaggatcttaccgtaaaaccgttacccgaacgccgcaaacaccttgaagaagtcttggttcagtccgatacgtggcgtttggccgagcatatctataccgacaaaccagaggaacttgaacaattctttttacgcgcgattgaagatggcgctgaaggagtgatggcaaaagcggtacatagccgctcaatttaccaggcaggtgctcgtggttggctctggatcaaatataaacgcgactataaatcggagatgattgatacggtggatttagttgttgttggcgccttctacggcaaaggccgtcgtggtggcaaatttggagcgttgttaatggccgcctatgatccggacaccgacacgtttaagactgtctgcaaagtaggtagcggctttaccgatgaagatcttgaacgtctcaacgaaatgctcaaaccgtacatcatccctcacaaacatccacgcgtggacagtaagatgaaaccggatgtctgggtacagccagcgttggtggctgagattattggtgcggaattaaccctttccccgatccacacgtgttgtcatggctgggtgaaacccggagcgggcatttctattcgtttcccgcgctttattcgctggcgcccggataaaagccctgaagatgcaaccaccactaaggagttgtatgagatgtacaaacgccagctccacaagatcgaagagaagacagcaacgcgtgaagccgct

SEQ ID NO: 16 - protein, 620 aa, synthetic construct
  REGION 1..620: note = Homolog of Bacillus phage JL DNA ligase
MHHHHHHGGSGMPMPFSILAETFEKLERTTSRTQMVLYLVDLFKKTPPETIDKVVYFLQGKLWPDWKGLPELGVGEKTLIKAVSIALHVPERTVEELAKRLGDLGLAVERLKREKEKGAKAVGLLAFMKQPSSGESTLTVEKVYDTLARVALTTGEGSRELKLKLVAGLIAEASPREAKYIVRFIEGRLRLGVGDATIIEALSIVYAGSAAMKHVVERAYNLRADLGLVAKILATQGVEAVKNIKPEVGIPIRPMLAERLNNPVEILKKLGGRALVEYKYDGERAQIHKKGDKIWIFSRRLENITKMYPDVVEMALKGIKANEAIVEGEIVAIDPDTGELRPFQELMRRKRKHDIHIAMKEVPVAVYLFDILYRDGEDLTVKPLPERRKHLEEVLVQSDTWRLAEHIYTDKPEELEQFFLRAIEDGAEGVMAKAVHSRSIYQAGARGWLWIKYKRDYKSEMIDTVDLVVVGAFYGKGRRGGKFGALLMAAYDPDTDTFKTVCKVGSGFTDEDLERLNEMLKPYIIPHKHPRVDSKMKPDVWVQPALVAEIIGAELTLSPIHTCCHGWVKPGAGISIRFPRFIRWRPDKSPEDATTTKELYEMYKRQLHKIEEKTATREAA

SEQ ID NO: 17 - DNA, 1824 bp, synthetic construct
  misc_feature 1..1824: note = Homolog of Bacillus phage JL DNA ligase
  source 1..1824: mol_type = other DNA
atgcaccatcatcatcatcatggcggtagcggcatgaaatttggtatggttgccgaatatttcgcgaaactggaggatattagcagccgcttgcagctgagtgcaaccctcgctgaactgtttcgttctgcagacaaggccgtgctggataaagtcgtctacttgatccaaggcaaattatggccggatttcttaggcatgccagaaattggtgtgggcgagaaactgctgatcaaagctgtagcgttgggtacgggacgcaacgaaggcgaagttgaatccgtgctgcgtaagatgggtgacttaggagaggttgcggcctcgctgaaaggcggcaataagatggactcactcactgcgtttctgggtacccgcgatgaaggtgaactgacagtggaggaagtccatgagaaactcgcaaaagtagccctggcgagtggcgaacgtagccgcgatattaaagtgcgtaccctggcgggccttgttaaacgcgcaacgccgatcgaagccaagtatattgtgcgtttcgtcgatggtaaacttcgccttgggatcggagacgctaccattctggatgcgttgtcgcaggcatttggcggctccaaagcggatgtagaacgtgcttacaacttacgcgccgacctgggtcagatcgcgaaactgctggccgagggtggtgcagaagcgatttcttctgttcgtgtgacggtgggcattcctgttcgcgtcatgcttgccgaacgtttaagcgaagctggcgagatcatggaaaaggtcggtggaaaagcgctggtggattataaatacgatggcgaacgcgcccaaatccaccgtaaaggtcagaccgttactgtgttctcacgccgcatggagaatattacaagccagtatccggacgtggtacaatgggtccgtgattatctgaaagcagaagaactcatttgcgaaggcgagatcgttgcggttgatcccgctacgggagacatgcgtccgtttcaggaattgatgcatcgcaagcgtaaagccgatgtactggaggcgaccaaagaatacccagtgaacctgtttctgttcgacttgttgtatcttgaaggcgaggattttaccaccaagaatcagttagaacgccgccgtaaactcgaagaactggtctcccaagagcaggacaaagtgaaagtagcacaatcgatgattgtggaagatcgtgcgaaactggaggagttcttctttcgcgccatcagtgatggtgctgaaggcgtcatggttaagagcatttcaccggactcgatctaccaggcgggtgcacgtggctggctgtggattaaactgaaacgcgattataagagtgaaatggccgacactgtggatctggttgttgtgggtgcgatttacggacgtggcaaacgcggtggcaaatttagcagcttactcctggcagcgtatgatgaagaaacggacacctttaagacggtctgtaaagtagcaagtggcttctccgatcaggaactggatcaaatgcaggaacttgtgcgtaaacacgctatccctcatcgtcacccgcgcgtggagtcttctattgaagccgacgtatgggttgagccctcactggtcatggaagttcgcggtgcggaacttacattgagcccgctgcatacttgctgcctgaactcgtatcgtgaaggcatgggaatctccattcgctttccacgtttcatccgctggcgcgaggataaatcaccggatgatgctaccaccagcaaagaaattctcgaaatgtaccgtaatcgcctgaagaaagtggaggtggaaggtgacgaatcggtg

SEQ ID NO: 18 - protein, 608 aa, synthetic construct
  REGION 1..608: note = Homolog of Bacillus phage JL DNA ligase
MHHHHHHGGSGMKFGMVAEYFAKLEDISSRLQLSATLAELFRSADKAVLDKVVYLIQGKLWPDFLGMPEIGVGEKLLIKAVALGTGRNEGEVESVLRKMGDLGEVAASLKGGNKMDSLTAFLGTRDEGELTVEEVHEKLAKVALASGERSRDIKVRTLAGLVKRATPIEAKYIVRFVDGKLRLGIGDATILDALSQAFGGSKADVERAYNLRADLGQIAKLLAEGGAEAISSVRVTVGIPVRVMLAERLSEAGEIMEKVGGKALVDYKYDGERAQIHRKGQTVTVFSRRMENITSQYPDVVQWVRDYLKAEELICEGEIVAVDPATGDMRPFQELMHRKRKADVLEATKEYPVNLFLFDLLYLEGEDFTTKNQLERRRKLEELVSQEQDKVKVAQSMIVEDRAKLEEFFFRAISDGAEGVMVKSISPDSIYQAGARGWLWIKLKRDYKSEMADTVDLVVVGAIYGRGKRGGKFSSLLLAAYDEETDTFKTVCKVASGFSDQELDQMQELVRKHAIPHRHPRVESSIEADVWVEPSLVMEVRGAELTLSPLHTCCLNSYREGMGISIRFPRFIRWREDKSPDDATTSKEILEMYRNRLKKVEVEGDESV

SEQ ID NO: 19 - DNA, 1833 bp, synthetic construct
  misc_feature 1..1833: note = Homolog of Bacillus phage JL DNA ligase
  source 1..1833: mol_type = other DNA
atgcaccatcatcatcatcatggcggtagcggcatggaatttaaactgattgcggaatatttcgataagttagagaagatcagcagccgtctgcagctcaccgccttgttgacggacctgtttaagaaagcagataagaacgtgattgacaaagttgtttacctgatccaaggcaaattatggccggatttcctgggttatccagaactgggagtaggcgagaaactcctcattaaagcgatcagtattgccgtcaatgtgaaagaagaagtggtggaagaacagctgaaagtagtcggtgatcttggcgaggttgcaatgcgcctgaagaagactccgcagtctgcgtcgatcctgtcatttctgggtgcccaatccaacgaggggttgaccgtcgaagaaacgtacgaaagcctgaccaagattgctttagcttctggcgagggtagtcgcgacatcaagattcgttcgcttgcggggctgttgaagaaagcatcccctctggaagcgaaatatattgttcgcttcgtagatggccgtcttcgcgtgggaatcggtgatgccacaattatggacgctttaagcaccgcatttactggctcgacgtcatttcgtccgctgatcgaacgcgcgtacaatctgcgtgccgatctgggcaacatcgcgaagattattgcacagcagggtgtggaggcgctcaaagacatcaaaccgcaagtcgggattcccattcgcccaatgcttgccgaacgtatgagtgatccggctgaaatcctggccaaagttggtggcgaagcgctggtggactataaatatgatggagagcgcgcgcagatccataagaaagataaagaagtgtacattttctcccgtcgtctggagaatattacccgcatgtatcctgatgtcgtcgaatacgttcgcgagtatatcaacgcaaatgaagtgattattgaaggcgaaatcgtagctgttgacccggaaagcaacgagatccgtccctttcaggaattaatgcaccgcaaacgtaagaacgatattaatgaagccatcaaagaatacccggtaaacgtgtatttgttcgatctgatgctctatgaggacgcggactacacaatgaaaccgctgccagaacgccgcaagaaattggaggaggtgatcaaaccgaatgataaactgcatattgcacaccacatctataccaacaacgtggataaactgatggaattcttctacgatgccatttctaatggtgcggaaggcgttatggtcaaaagcgtggctaaagactcgatctatcaagcgggttcacgtggctttctgtggattaaacttaaacgtgattaccagagtgaaatggcagatagcgttgacttggtcgttgttggcgccttctatggtcgcggaaaacgtggtgggaaactgtcttccctcttaatggcggcgtacgatcctgaaacggacacctttaagacggtgtgcaaagtcgctagcggcttttcggatgccgaactggatgagctgcagaagaaacttatggagattaaactggacaagaaagatccgcgcgtggactcccaactggaaccagatatttgggtagaaccgaaatatgtggcagaaattattggcgccgagatcactttgagtcctgaacatacgtgttgtaaagatatggtatcaaaaggtgcaggcttaagcgtccgttttccgcgctttatccgttggcgcgacgacaaatctatcgaagatgccaccacccccaaagagatttatgaaatgtacaagatgaaactgcgcaagaaagaagaagaacagcatacagatgaggct

SEQ ID NO: 20 - protein, 611 aa, synthetic construct
  REGION 1..611: note = Homolog of Bacillus phage JL DNA ligase
MHHHHHHGGSGMEFKLIAEYFDKLEKISSRLQLTALLTDLFKKADKNVIDKVVYLIQGKLWPDFLGYPELGVGEKLLIKAISIAVNVKEEVVEEQLKVVGDLGEVAMRLKKTPQSASILSFLGAQSNEGLTVEETYESLTKIALASGEGSRDIKIRSLAGLLKKASPLEAKYIVRFVDGRLRVGIGDATIMDALSTAFTGSTSFRPLIERAYNLRADLGNIAKIIAQQGVEALKDIKPQVGIPIRPMLAERMSDPAEILAKVGGEALVDYKYDGERAQIHKKDKEVYIFSRRLENITRMYPDVVEYVREYINANEVIIEGEIVAVDPESNEIRPFQELMHRKRKNDINEAIKEYPVNVYLFDLMLYEDADYTMKPLPERRKKLEEVIKPNDKLHIAHHIYTNNVDKLMEFFYDAISNGAEGVMVKSVAKDSIYQAGSRGFLWIKLKRDYQSEMADSVDLVVVGAFYGRGKRGGKLSSLLMAAYDPETDTFKTVCKVASGFSDAELDELQKKLMEIKLDKKDPRVDSQLEPDIWVEPKYVAEIIGAEITLSPEHTCCKDMVSKGAGLSVRFPRFIRWRDDKSIEDATTPKEIYEMYKMKLRKKEEEQHTDEA

SEQ ID NO: 21 - DNA, 1842 bp, synthetic construct
  misc_feature 1..1842: note = Homolog of Bacillus phage JL DNA ligase
  source 1..1842: mol_type = other DNA
atgcaccatcatcatcatcatggcggtagcggcatgtctcaaaccggtgaagatttaccgtatagtgtgctggcggacttctacgagaagattgaaagcatcacgtcgcgtattgccatgaccgattatctggtcgcactctttaagaaaacaccaccctccatcatcgacaaagttatttacttgactcaggggcagttacgcccggattatgaaggcgtggagcttggcgtagctgagaaattggcgcttcgtgcattggctcgcgcgaccggtcgccatgtcaaagatgtggaagacatgtacaaacaaacgggagatattggccttctcgccgaaaaactcatgagcacctcacgtacgggtggcttattggattttatcggtactatggaaccgaagaaagaactcaccgtttcgcaggtgtataacgccctcttacgcattgcacaggccacaggagaaggcgctcaggagaccaagatcaatacgcttgttagccttcttaaagacgcgaaacctaaagaagcgcgttacattttacgcaccgtattgggtcgtttacgcttggggatcgcggatatgacgattctcgatgcattagccattgctttcaccggctccaagaacactcgtgacatcgtcgagaaagcgtatacaaaacacccggatttgggctatattgccaagttacttgccagtcaaggtatcgatgcggtggctagcctcaagattgaagttggcgtgcctatcttgccaatgttagcagaacgcctctcagacccggatgagatccttcagaaattgggtggtaaatgcctcgcggaatacaaatatgatggcgaacgtgtccaggcacataagaaaggagagaaagtctggttgttttctcgtcgccttgagaatattacccaccactatccggacgtggtggaatacatgaaacaactcaaagcggatgaagcgattgttgaaggcgaaatcgttgcctataaccccgacacgggtgagatgcttccattccaggagttgatgcatcgtcgccgcaaatacgatgtagacaaagccatgaaagaatatccggtgcgtgtctacctctttgatattgtctacttaagtggccgcgagttgatcgatgaacctttaccggaccgtcgtcagaaccttgaaaagattgtaccggaagggcaggaaaatttgctcttatcgagcgcgaagatcatcgataattccaaagatttgcttcatttctttgaacaagccatttctgatggttgtgaagggatcatgtgcaaaagcattggcccggactcagtgtatcaaatgggtgcacgcggatggctctggatcaagtttaaacgcgattaccgccttgaaatgaccgacactgtagacttagttgtggttggcgcgttcaaagggcgtggtaaacgtgctggcacctatggcgccctcttaatggcggcatatgatccagagacggatacctttaagactgtgtgtaaagttggttcggggttcacggatgaagacttagctaaccttccgaagatgttggaaccctacattttacctcatcgccacccgcgtgtgttttccaagatggaagcagatgtctggtttgttccggcggtggtgttggagattattggcgccgaaattacccttagtccgctccatacgtgcgccctcaacaagatcgaagaaggtgtaggcttagcgattcgtttcccacgctttacaggtcgctatcgcttcgacaagaaacctgagcaggcaaccaccgaagccgagctcatcgaaatgtacaaaagccagcgtaagactattatccaacaatcg

SEQ ID NO: 22 - protein, 614 aa, synthetic construct
  REGION 1..614: note = Homolog of Bacillus phage JL DNA ligase
MHHHHHHGGSGMSQTGEDLPYSVLADFYEKIESITSRIAMTDYLVALFKKTPPSIIDKVIYLTQGQLRPDYEGVELGVAEKLALRALARATGRHVKDVEDMYKQTGDIGLLAEKLMSTSRTGGLLDFIGTMEPKKELTVSQVYNALLRIAQATGEGAQETKINTLVSLLKDAKPKEARYILRTVLGRLRLGIADMTILDALAIAFTGSKNTRDIVEKAYTKHPDLGYIAKLLASQGIDAVASLKIEVGVPILPMLAERLSDPDEILQKLGGKCLAEYKYDGERVQAHKKGEKVWLFSRRLENITHHYPDVVEYMKQLKADEAIVEGEIVAYNPDTGEMLPFQELMHRRRKYDVDKAMKEYPVRVYLFDIVYLSGRELIDEPLPDRRQNLEKIVPEGQENLLLSSAKIIDNSKDLLHFFEQAISDGCEGIMCKSIGPDSVYQMGARGWLWIKFKRDYRLEMTDTVDLVVVGAFKGRGKRAGTYGALLMAAYDPETDTFKTVCKVGSGFTDEDLANLPKMLEPYILPHRHPRVFSKMEADVWFVPAVVLEIIGAEITLSPLHTCALNKIEEGVGLAIRFPRFTGRYRFDKKPEQATTEAELIEMYKSQRKTIIQQS

SEQ ID NO: 23 - DNA, 1833 bp, synthetic construct
  misc_feature 1..1833: note = Homolog of Bacillus phage JL DNA ligase
  source 1..1833: mol_type = other DNA
atgcaccatcatcatcatcatggcggtagcggcatgttagcagatacctttgaatctttggagagcattacagcgcgtacgcagatggtgaacatcctggttgccctgctgaagaaaactccggcggaaattattgaccgcgtcgtctatatcatcgaagaacgcctctggccagattggaaaggcctgccggaacttggtgtagccgagaaatccattattcgtgcaatcgctgttgctaccgggcaatcggatgatgtggtggaacgtaccgcgaaaacgttgggagacctgggtaaagccgcggagagtctgatctcaaccgtacgcgaaaagcagaaacgcactactagcttactttcgttcgttaccagccgtcgtgaactgaccgtgtctcgcgtgtacgacacgtttgtccgcattgcaatggctcagggcgagggctccaaagatatcaagattcgtctcctgagcggtttattagcggaagcatcccctaaagaagcgcgctatattgttcgtttcgccgagggcaaattgcgtcttggtgtaggcgaagcgacgctcatggatgcattggctgtggcgtttggaggagggagtttcgcacgcccgatcatcgaacgtgcgtacaatttgcgcgcggaccttggtgaggttgctcgtgtggtggcaaccaaaggcattgaagagctcaaagcgcttaaacccgttgtcggcattccgattcgcccaatgttagctgaacgccataacaacccgaaggaaatcttggagaaagtaggcggtgtgggttttgtcgagtataagtacgatggcgaacgtgcgcaaatccacaagaaaggtgatgaagtggtcatcttttcacgtcgccttgagaatatcacgcatcagtatccggacgttgtggattatgttaaacgtggcgtcaaagcagaagaagcgattgtagaaggtgaaattgtggctattgaccctgatacaggcgaattcaaaccctttcaggagttaatgcaccgcaaacgcaaacatgatgttatgtcggtggtgaaagaaattccggttcgtgtgtacttgttcgaccttctttacctcaatggtgtcgattataccgtcaaaccattaccggaacgccgcaaagcattggaagaagtaatcgagaagaacgaagggttagatattgcggagtatatcaccgctaagaatcctgtagagttggagaagttctttatgggcgcgattagtgatggagcagaaggcgtgatggtcaaagcgatccacaaagacagcatttaccaagcgggtacacgtggttggttgtggatcaagtttaaacgtgactatcgcagcgaaatgattgatacggtggatttggttgttgtaggcgcattctatgggcgtgggcgtcgtggtggtaaatttggtgcgcttttaatggctgcttacaacgaagagaaagacgtctttgaaaccgtgtgcaaagttggatctgggttcactgatgaagatttgaaccagttaccggaccttctcaaaccgtatattgtggataagaaaccagcacgtgtggtgtcaaatattcagccggacgtttgggtagttccgaaattagtcgcggaaatcatcggcgcagaattgaccctcagtccccttcatacgtgtgcggtcggtaaagtgcgtggtgatgctgggatttcgatccgctttccacgcttcattcgttggcgcgacgataaaagccctgaagatgcgaccacatccaacgagctctttgaaatgtacaagaaccagctcaagaagatcgctgagaaaccgggtgaaggagaagcaacg

SEQ ID NO: 24 - protein, 611 aa, synthetic construct
  REGION 1..611: note = Homolog of Bacillus phage JL DNA ligase
MHHHHHHGGSGMLADTFESLESITARTQMVNILVALLKKTPAEIIDRVVYIIEERLWPDWKGLPELGVAEKSIIRAIAVATGQSDDVVERTAKTLGDLGKAAESLISTVREKQKRTTSLLSFVTSRRELTVSRVYDTFVRIAMAQGEGSKDIKIRLLSGLLAEASPKEARYIVRFAEGKLRLGVGEATLMDALAVAFGGGSFARPIIERAYNLRADLGEVARVVATKGIEELKALKPVVGIPIRPMLAERHNNPKEILEKVGGVGFVEYKYDGERAQIHKKGDEVVIFSRRLENITHQYPDVVDYVKRGVKAEEAIVEGEIVAIDPDTGEFKPFQELMHRKRKHDVMSVVKEIPVRVYLFDLLYLNGVDYTVKPLPERRKALEEVIEKNEGLDIAEYITAKNPVELEKFFMGAISDGAEGVMVKAIHKDSIYQAGTRGWLWIKFKRDYRSEMIDTVDLVVVGAFYGRGRRGGKFGALLMAAYNEEKDVFETVCKVGSGFTDEDLNQLPDLLKPYIVDKKPARVVSNIQPDVWVVPKLVAEIIGAELTLSPLHTCAVGKVRGDAGISIRFPRFIRWRDDKSPEDATTSNELFEMYKNQLKKIAEKPGEGEAT

SEQ ID NO: 25 - DNA, 1827 bp, synthetic construct
  misc_feature 1..1827: note = Homolog of Bacillus phage JL DNA ligase
  source 1..1827: mol_type = other DNA
atgcaccatcatcatcatcatggcggtagcggcatggaactgaaaattttagttgaagcgtttaaccagctggagaagatcaccagccgcacgcagatcaccaatgtggtggtcaacgtcctcaagaacactccgaaagaaattgtggataaagtggtatatttgctgcaaggcgttctttggcctgactggaaaggtttgccagaattaggagtcggcgagaaatacctgattaaagccatcgcaaaagctacaggtagttcggaagaagaggttgagaagacctataagacgtccggcgatctgggtaagactgcggaaatgctgaagatgcgtaaatcagccggcgggctgaccaaattcctgagcagctctacgggacgcgcaggtcttaccgtggagaaagtatacgataccctcgcgaagattgctctgactacaggtgaaggctcgcgtgacctgaagatcaatttaattgccgggttgttgacggaagcaacaccgtccgaagcgaaatttatcgttcgcttccttgaaggccgtctccgccttggcttaggtgaagcgacgattctcgatgccttagcgatcgtgtttggcggatctcaggcttatcgtccgattgtagagcgcgcctacaatattcgtgcagacctcggttcaatcgctcgcttgattgcgtatgaagggatcaaaagcattgagaacatcaaacccgaagtcggcattccgatcaaaccaatgttagccgaacgtcttgataatccggaagagattttgagtaaagtgggtggtaaagcactcgttgagttcaaatatgatggcgaacgcgggcagatccataagaaagacgacaccgtgtacatcttttcgcgtcgtcttgaaaacattacccaccaatatcctgatgtcgtcgaaatggttcgtacgcatgtgctgagcaacgaagcgattttagaaggcgagattgtagcaactgatccggaaacgggtgaattacgcccgtttcaggagcttatgcaccgtaaacgcaaatacgatatccatgaagtgattaaagaaatccccgtgaaagtgttcttgtttgacatcctctataatgaaggcgaggatctcaccaccaaaccaattgcgtaccgtcgtgaagtactcaagaaagtcgtcaaagaatccgaggatttccgcattgccgactatatcatcacggaagatccgcaagagttggagaaattctttctttactgcattgaaaacggtggcgaaggagtagtagtgaaagccttacactctaatgcgatttatcaggcgggtgctcgcggttggctctggatcaaatataaacgtgactacaagagtgaaatgattgatacagtggatttagttgtcgtgggcgcatttgccggacgcggcaaacgtggtggcaaatggggtaccttgttgatggcggcgtatgacaagaagacggatacctttaaaaccgtgtgtaaattaggcactggcttcacggataaagaccttgaagaaattactgagatgctcaaacctatcaccttgagccataaacatccgcgtgtcgattcagatattgaaccagacatctgggtaattccgcagtacgtggctgaagtcttaggagctgaactcacgcttagtccgcttcacacctgctgcaaaggtgccgtgaagaaagatgcaggcatctcgattcgctttcctcgcttcatcaaatggcgtcccgacaagaaaccggaggatgccacaacaaccgatgaacttttggagatgtatcgccgccaactcaagaaagtcgaagaaagcccaactcca

SEQ ID NO: 26 - protein, 609 aa, synthetic construct
  REGION 1..609: note = Homolog of Bacillus phage JL DNA ligase
MHHHHHHGGSGMELKILVEAFNQLEKITSRTQITNVVVNVLKNTPKEIVDKVVYLLQGVLWPDWKGLPELGVGEKYLIKAIAKATGSSEEEVEKTYKTSGDLGKTAEMLKMRKSAGGLTKFLSSSTGRAGLTVEKVYDTLAKIALTTGEGSRDLKINLIAGLLTEATPSEAKFIVRFLEGRLRLGLGEATILDALAIVFGGSQAYRPIVERAYNIRADLGSIARLIAYEGIKSIENIKPEVGIPIKPMLAERLDNPEEILSKVGGKALVEFKYDGERGQIHKKDDTVYIFSRRLENITHQYPDVVEMVRTHVLSNEAILEGEIVATDPETGELRPFQELMHRKRKYDIHEVIKEIPVKVFLFDILYNEGEDLTTKPIAYRREVLKKVVKESEDFRIADYIITEDPQELEKFFLYCIENGGEGVVVKALHSNAIYQAGARGWLWIKYKRDYKSEMIDTVDLVVVGAFAGRGKRGGKWGTLLMAAYDKKTDTFKTVCKLGTGFTDKDLEEITEMLKPITLSHKHPRVDSDIEPDIWVIPQYVAEVLGAELTLSPLHTCCKGAVKKDAGISIRFPRFIKWRPDKKPEDATTTDELLEMYRRQLKKVEESPTP

SEQ ID NO: 27 - DNA, 1266 bp, synthetic construct
  misc_feature 1..1266: note = Homolog of Bacillus phage JL DNA ligase
  source 1..1266: mol_type = other DNA
atgcaccatcatcatcatcatggcggtagcggcatgcaggcagaagatgaactgtttaacctcttggaggaggaaaccagctatccgtatcctgtgcagcaagttctgaatttcgaagaccaaccgacgtgcagtgattgggcgctggtaccgctgtacaagaccactatggaaggccgcgattcgaactggcaggtcgggttctgtgaagctgaaggtcgtctgtggatcaaacatggccttgacatttcacacgcccagattaaaacacgcgagatcaagaccaataattctggtcgttccttacaggaacaagcgttgttagaagcccgtaaccgctaccgcaagatgtattataaaggctactacacggcgaaaggagaagtgtgcgttcatgagccaatgctggcaaacaaatataaccccggcaagaatgtgaaactgtttccggtcgctgtgcaggccaaactcgatggtgtacgtgcgctgatgacccgcagcaacgagggtgacacttgtagcggcgtcaagattcttagtcgtacggggcgcgaatggccacacctggcattgatccgtgaagaagttcgcgagttctttcagtatttacctcctggttgcgtgctggatggcgagatttactccaccgaactgtcgtttgatgaactgtctggacttatgcgtaccacaaaaggtgaccgcagcaaagaggataaagcgcaatattatatctttgatctcattgacccgttcgattcatactttgaagttcgctacaaaatcctgtcggatgccttcacgagctttgaacaggaccgtgaagcgaaattcctgcaagtaatgccggtgtttttggctgattcccatgagtctattgttcaggcacacgacgaatgggtcagttcaggcatggaagggtgtatgattcgtcgtctgagctatgtggaggagaataaagcgctgtgcctctataaaccacgccgctgtaacaaccttctgaaatacaaatcgtttgatgatgaagaagtgaccatcgtcgaagttggtcagggagccggcactgaagaaggcttggccgtgttcacggtacaggacaagaaaggcaatcgttttgaagtacgtccgcgcggtgatttcgcacaacgcaagatttggtttgaacagccggagaaagtcctgggtcaaccctataccatccgtttcttcggcaagaccgcgaaagggattccgcgctttccggttggcatcggtctgcgtaattacgag

SEQ ID NO: 28 - protein, 422 aa, synthetic construct
  REGION 1..422: note = Homolog of DNA ligase from Bacillus phage JL txaon ID 1296655
MHHHHHHGGSGMQAEDELFNLLEEETSYPYPVQQVLNFEDQPTCSDWALVPLYKTTMEGRDSNWQVGFCEAEGRLWIKHGLDISHAQIKTREIKTNNSGRSLQEQALLEARNRYRKMYYKGYYTAKGEVCVHEPMLANKYNPGKNVKLFPVAVQAKLDGVRALMTRSNEGDTCSGVKILSRTGREWPHLALIREEVREFFQYLPPGCVLDGEIYSTELSFDELSGLMRTTKGDRSKEDKAQYYIFDLIDPFDSYFEVRYKILSDAFTSFEQDREAKFLQVMPVFLADSHESIVQAHDEWVSSGMEGCMIRRLSYVEENKALCLYKPRRCNNLLKYKSFDDEEVTIVEVGQGAGTEEGLAVFTVQDKKGNRFEVRPRGDFAQRKIWFEQPEKVLGQPYTIRFFGKTAKGIPRFPVGIGLRNYE

SEQ ID NO: 29 - DNA, 1554 bp, synthetic construct
  misc_feature 1..1554: note = Homolog of Bacillus phage JL DNA ligase
  source 1..1554: mol_type = other DNA
atgcaccatcatcatcatcatggcggtagcggcatgattctggatatcttgaacgaaattgcgagcatcgactcgaccaaaagtaaagaggccattattgcacgcgaaaaggataatgaactgctgaaacgtgtgtatcgcatggcttacacgcgtcgtctcaactacggcatcaagaaatggccggaaccaggttttacttcccagtctttcgggatgatcacccttgaggatctgctggactttgcggaattcacactcgcaacccgcaaaattactggcaatgccgccatcgaggaactggcgcaaattattgcggatgctaaaggtccggacgcagaagttttacgtcgtgtcatgatgcgcgatttagaatgcggagccagcatctcaatcgcgaacaaagtatggaaaggcctgatccctgaacagccgcagatgttggcttcgtcgtatgatgaggaccttattaagaagaatattaaatggcccgcatttgcgcaactgaaagcggatggtgcacgctgtttcgctgaagtgcgcaacgatggcgttacgtttttaacccgtggtgggaacgagtatcagggcctgaatttgttggcggcggaactcatggcaatgacggaagaagctcgccaacgtcatccgaacggagtgatgattgacggtgagctggtctaccacaccccaaaagtggaaccgaaagcgagcaatgatctgttctccatgtttgacgaagaactgcctgagctgagcaaagcaaaagagtttcagaccgttgctgatcgctctacgagtaacggcctggcgaataaagcgcttcagggcacaatcaccccgactgaagcagcaggtatggtattacaagcgtgggattatgtcccactggatgtggtgtactcagaaggcaagattaaaggtgacaagtatgatgttcgtttcgctgctctggaactcatggtagcgcataacgtcgttttacacgggacgacacgcgtggaggcgatcgagaatcagtgggtgaacaaccttgacgaagcaaaagttgtctacaagaagtatgtagatcagggcctggaagggattattctgaagaatatggacagctattgggaaaatcgtcgtagtaagaacctgatcaaatttaaagaagtgattgatatcgcgttggaagtcgtcggttactacgagcattccaaagatccgaacaaattaggaggcgtggaactggtttctcgttgccgccgcattacctcagactgtggtagcggcttcaaagataccacccacaagaaagataaatcgggcaagaaagtgctgattccgttggaagatcgccctgacctggaccgtgagctcctcatgaaacaagcacgcgaaggtaaacttatcgggcgtatcgctgattgcgaatgtaatggctgggtgcatagtaaaggtcgcacggatactgttggcatctttctgcccatcattaaaggatggcgttttgacaagaccgaagcggatacgttcgaggacgtatttggtgattggtctcagacaggcctc

SEQ ID NO: 30 - protein, 518 aa, synthetic construct
  REGION 1..518: note = Homolog of Bacillus phage JL DNA ligase
MHHHHHHGGSGMILDILNEIASIDSTKSKEAIIAREKDNELLKRVYRMAYTRRLNYGIKKWPEPGFTSQSFGMITLEDLLDFAEFTLATRKITGNAAIEELAQIIADAKGPDAEVLRRVMMRDLECGASISIANKVWKGLIPEQPQMLASSYDEDLIKKNIKWPAFAQLKADGARCFAEVRNDGVTFLTRGGNEYQGLNLLAAELMAMTEEARQRHPNGVMIDGELVYHTPKVEPKASNDLFSMFDEELPELSKAKEFQTVADRSTSNGLANKALQGTITPTEAAGMVLQAWDYVPLDVVYSEGKIKGDKYDVRFAALELMVAHNVVLHGTTRVEAIENQWVNNLDEAKVVYKKYVDQGLEGIILKNMDSYWENRRSKNLIKFKEVIDIALEVVGYYEHSKDPNKLGGVELVSRCRRITSDCGSGFKDTTHKKDKSGKKVLIPLEDRPDLDRELLMKQAREGKLIGRIADCECNGWVHSKGRTDTVGIFLPIIKGWRFDKTEADTFEDVFGDWSQTGL

SEQ ID NO: 31 - DNA, 1314 bp, synthetic construct
  misc_feature 1..1314: note = Homolog of Bacillus phage JL DNA ligase
  source 1..1314: mol_type = other DNA
atgcaccatcatcatcatcatggcggtagcggcatgaaagtgttctttgaaaacaaacgcaagcataagatgctgccgaccctttatagcaagtcgaagacgggcaaattgatgcagtggaaagtctggactgaggaggatgaaattgttaaagaatttggttacaaagacgggaaactgcgtcaagtacgcaccaaagcgaaacctaagaatagtggcaagacgaacggtacaacagcctctgaacaggctatctccgaagcaaaagcggattggaccaaacagctggacaaaggatatttcgccgatgaggaagatgaagaagcgagcctgtttgtgtcaggcgttctccaagcaaaagaagagtcgggtgggaataatcacaacattatggacaagaaagtgtctgccccgaagaaagtccagaagaagatcttcttgccaatgctggcggataaataccatgagttaatggctccgagcaaaggcaaacgtcgtgcagagaaatttgaatatagtaaagcttcatgcgcgcagcccaaactggatggtgtacgctgtgttgcccgcattgtggacggcaacgtcgaactcttatcccgtaaaggcaaacaaatcctgcacctggagcatattcgcgaagaagtgaaagaactgctgaaaggtaatgaaggagttatccttgatggcgagctctactttcacgaaagcgatatgccgcagaacaagaaattcgaattgatttctggtgcagcacgtagtacccgcacgaaaccacatccggaagaactgcgtatccagtattgggtgtttgacattgtcaatactgaacgcacctggttcgatcgtgactatgagctggggcttctgtttaaagataaagaaatggagtacatcgtattggtggaaacgcgcctggttctgagcgaagatgagatgctcgaacatcatcgtcgttggaccggcgaaggtttcgaaggcaccattttacgcgacgaacgcatgatgtatactcctggtaaacgttcccgcttactgctgaaatgcaaggattttgaagactcggagtacgagattgtggatgtcctgaaaagcgaaggaggaacggaagatggttgtgccatcttccttttagaaaccgaaacagggaacacctttacttgccgtccggttggtacgttggagaaacgccgcaagatgtataagaacaagaaatccctgattgggaaagaggtgaccgtaaaataccaaggtcgtgacgagaagacggaaatcccgcgttttccagttgttgtcgggattcgcgattatgag

SEQ ID NO: 32 - protein, 438 aa, synthetic construct
  REGION 1..438: note = Homolog of Bacillus phage JL DNA ligase
MHHHHHHGGSGMKVFFENKRKHKMLPTLYSKSKTGKLMQWKVWTEEDEIVKEFGYKDGKLRQVRTKAKPKNSGKTNGTTASEQAISEAKADWTKQLDKGYFADEEDEEASLFVSGVLQAKEESGGNNHNIMDKKVSAPKKVQKKIFLPMLADKYHELMAPSKGKRRAEKFEYSKASCAQPKLDGVRCVARIVDGNVELLSRKGKQILHLEHIREEVKELLKGNEGVILDGELYFHESDMPQNKKFELISGAARSTRTKPHPEELRIQYWVFDIVNTERTWFDRDYELGLLFKDKEMEYIVLVETRLVLSEDEMLEHHRRWTGEGFEGTILRDERMMYTPGKRSRLLLKCKDFEDSEYEIVDVLKSEGGTEDGCAIFLLETETGNTFTCRPVGTLEKRRKMYKNKKSLIGKEVTVKYQGRDEKTEIPRFPVVVGIRDYE

SEQ ID NO: 33 - DNA, 1143 bp, synthetic construct
  misc_feature 1..1143: note = Homolog of Bacillus phage JL DNA ligase
  source 1..1143: mol_type = other DNA
atgcaccatcatcatcatcatggcggtagcggcatggatctgccgattaaaccaccagttgaaccgatgttggcgaaaagcgtgcctcagttacctaccgcaccaggcatgacttatgagcccaaatgggacggttttcgctgcatcatcttccgtgatggagatgaagtagaacttgcttctcgtggcggtaagacaatgacgcgctactttcccgaagtcgtcgaacaagcccgtcgtcagctgcctcctcgctgtgcggttgacggcgagctgattgtgattcgccgcgatggtcccggcggccagccacgtctggacttcgaactcctcgcacaacgtatccatccagccgctagtcgcgtgaagatgttagcggaaaccacccccgccgattttgtggcgttcgatctgctggcaattgatgacgaggcgctgctggatcagccttatccagaacgtcgcgctcgcttggagaaagcgcttgccaaagttcgtccacctgtacacgtcacgcagatcaccacagatcctgaagcagcacgccgctggtttgaagtgtttgaaggtgccggactggacgggctgattgttaaatcggcggacttaccatacgaacccgggaaacgtctgatgttcaaagtgaaacatgcccgtactgcagatgtagtagtcgctggttttcgttggcacaaatccggtcctgttgtggggagcttgttgctgggcctctatgatgatgcgggcgtgctgcatcatattggcgtttcatcaagcttcactgccgcacgccgcaaggagcttttagccgagctggaaccctaccgtgacgtcggtggtgatcacccatgggtgcatggcgaccacgaacgtggccaacgtttgccaggtggagttagtcgttggaccggtacccgcaacctggagtgggaacccttacgtcccgaacttgtggctgaagtcggctatgatgcgatggaaggcgatcgcctccgccatacggcgcagtttgtacgctggcgtcctgatcgtgatccacgttcttgccgctatgaccagttggaacgtcctatccgctacgacgtggatcaagttttacgcggtgatccagcagccaccgctggttctgcaccaggacctgct

SEQ ID NO: 34 - protein, 381 aa, synthetic construct
  REGION 1..381: note = Homolog of Bacillus phage JL DNA ligase
MHHHHHHGGSGMDLPIKPPVEPMLAKSVPQLPTAPGMTYEPKWDGFRCIIFRDGDEVELASRGGKTMTRYFPEVVEQARRQLPPRCAVDGELIVIRRDGPGGQPRLDFELLAQRIHPAASRVKMLAETTPADFVAFDLLAIDDEALLDQPYPERRARLEKALAKVRPPVHVTQITTDPEAARRWFEVFEGAGLDGLIVKSADLPYEPGKRLMFKVKHARTADVVVAGFRWHKSGPVVGSLLLGLYDDAGVLHHIGVSSSFTAARRKELLAELEPYRDVGGDHPWVHGDHERGQRLPGGVSRWTGTRNLEWEPLRPELVAEVGYDAMEGDRLRHTAQFVRWRPDRDPRSCRYDQLERPIRYDVDQVLRGDPAATAGSAPGPA

SEQ ID NO: 35 - DNA, 1272 bp, synthetic construct
  misc_feature 1..1272: note = Homolog of Bacillus phage JL DNA ligase
  source 1..1272: mol_type = other DNA
atgcaccatcatcatcatcatggcggtagcggcatgtttgaaaagaccctgtatggcttaaacaaaggtggtgattacaaagtgtggagcattaaagcgcgtgacatcgatggagttggcgtcctgaatattgcctatggcgtatacggtggtacgatcatcgacgacaagcaggataacattaaagtgggcaaacaaggccgcactccgtatgaacaggcagttttcgaggctcagtcgcgcattaagaaacaattggataagaattaccgtgaaacctttgaggagctgaacgatctcccagtgcttgcgatgctgtccaaagatcatacaaaagccgggaaacagaagaccgtcgaagaaggagtgtatacgagtgacaaactggatggtttccgttgcatcgcgaaatgtttacacgcaccggggattggcaaatacgtctcactgttttctcgtaccggccagttatatcgcgttcctcatatcgaacaagaactgctgagcattatggaagtaggtgatattcttgacggtgagctctatgttcacggaccgactctgcaggaaatcagctcggctgtgaaacgtgaagatgccgaggagaaagtagaagcggcgtacctgaaagcagggaaagccctcaataaacatggcgtggaatccacgcagtataaaagtgcttgggcggactacgaagaatgctgcgccatttcttcatatcgcgatgcattgcaatatcacgtcttcgatatcgtgctgtttgacatgccctttgaggaacgtctggaagaattacgcaagcttgaacagcgtatgttggttgagggtttcgtggttgcggtccagtacaaatatgccgatagcattgaagaactgaacacccaactgaaagactgtatcgatcgcggctttgagggcattatgtaccgtacaaaggatggtgagtatgaaagtggcaaacgttcgagcgggctgtggaaatacaaattaatgcaggacgcggaattcgaaatcctggatgtgattgcagataaacaaggtgacggcatctttgtacttaagaatgatatgtccgatctgaccttcaactgtgttatgggttctttatcagaacgccgccagtttctggaaaacaacaatgaactggtgggcaaatatctgacggtcgcttttcaggcgcgttacaaagggaccttgttgccgcaattcccagtgggaaaactggttcgcgacggctatgtaaagaatggcaagtttattccgactatc

SEQ ID NO: 36 - protein, 424 aa, synthetic construct
  REGION 1..424: note = Homolog of Bacillus phage JL DNA ligase
MHHHHHHGGSGMFEKTLYGLNKGGDYKVWSIKARDIDGVGVLNIAYGVYGGTIIDDKQDNIKVGKQGRTPYEQAVFEAQSRIKKQLDKNYRETFEELNDLPVLAMLSKDHTKAGKQKTVEEGVYTSDKLDGFRCIAKCLHAPGIGKYVSLFSRTGQLYRVPHIEQELLSIMEVGDILDGELYVHGPTLQEISSAVKREDAEEKVEAAYLKAGKALNKHGVESTQYKSAWADYEECCAISSYRDALQYHVFDIVLFDMPFEERLEELRKLEQRMLVEGFVVAVQYKYADSIEELNTQLKDCIDRGFEGIMYRTKDGEYESGKRSSGLWKYKLMQDAEFEILDVIADKQGDGIFVLKNDMSDLTFNCVMGSLSERRQFLENNNELVGKYLTVAFQARYKGTLLPQFPVGKLVRDGYVKNGKFIPTI

SEQ ID NO: 37 - DNA, 1170 bp, synthetic construct
  misc_feature 1..1170: note = Homolog of Bacillus phage JL DNA ligase
  source 1..1170: mol_type = other DNA
atgcaccatcatcatcatcatggcggtagcggcatgattgatgatcgtaaaatgtctaccctgtataagatcgacgaaaacgacaatattcgcgagtggtttatccagctcgatggcaaccgttactgcgtgcatagcggtattcaaggagggaagacggttgtctcgaaatggaaagaagcgaaaccgaagaatgtaggcaaagccaacgaagtgtgtgcagaacagcaggctatcctggaggttgaacgcaaatatgtggagcaaaagaagactggcggttactacgataccgtcgaattagcgcgcgaaggcttcaagacgtattttcagccaatgttggccgagaaatggaaagaccgtaaacctacctggggtgcaacatttccgctttggagtcagccgaaactggatggttgccgcgctgtatccacctatgatgcgctgaaatcacgtgaaggcgaagccttcattacgcccaccaagatcatcaagattatgaaacgcctgcacgagatttatccgagctacgttttcgacggagaactgtacaaccataaatatcgtaatgactttgagaagattgtgagcttgatccgcaaacagaaaccaactgaagcgcacatcgaggaatgtaacgagaagattgaataccatatctatgatatgtttgatcgtaatcgcccggatcttcctttctcggaacgttttgcaattctgcaagggattctccacgacttcgatgaacgcatcgtcctggtggaaacaaaactggttcataacgaagaagaattggatgcgctgtatggtgagtaccttgagaatgaatttgaaggccaaatggtgcgtgtcgatggtccgtatgaaatgcgccgctccaagaccctgctgaaacgtaaagaattcgaagacgccgagtttcagattgagagtgtagaagaaggcgaagggaactggtctggcgctctcaaagtggtgtggatcaaattggaagatggtcgtaatcagaaagcaacgccacgcggcacctatgacgatttagcggcgctgctgaaagaggccgacacgttaccgggtaccgatgttactgtccgttttcaaggacgcactggtggcggcaaattacgtttccccattgtgaccgtattttggcgcgggaaacgtgatgtg

SEQ ID NO: 38 - protein, 390 aa, synthetic construct
  REGION 1..390: note = Homolog of Bacillus phage JL DNA ligase
MHHHHHHGGSGMIDDRKMSTLYKIDENDNIREWFIQLDGNRYCVHSGIQGGKTVVSKWKEAKPKNVGKANEVCAEQQAILEVERKYVEQKKTGGYYDTVELAREGFKTYFQPMLAEKWKDRKPTWGATFPLWSQPKLDGCRAVSTYDALKSREGEAFITPTKIIKIMKRLHEIYPSYVFDGELYNHKYRNDFEKIVSLIRKQKPTEAHIEECNEKIEYHIYDMFDRNRPDLPFSERFAILQGILHDFDERIVLVETKLVHNEEELDALYGEYLENEFEGQMVRVDGPYEMRRSKTLLKRKEFEDAEFQIESVEEGEGNWSGALKVVWIKLEDGRNQKATPRGTYDDLAALLKEADTLPGTDVTVRFQGRTGGGKLRFPIVTVFWRGKRDV

SEQ ID NO: 39 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaaccgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 40 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKTAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 41 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 42 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 43 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagacccgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 44 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKTRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 45 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacattgaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 46 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNIEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 47 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatctggcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 48 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDLAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 49 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcccggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 50 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIPEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 51 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctctgccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 52 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDALPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 53 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaagaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 54 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEEDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 55 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtctgaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 56 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRLNFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 57 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccggcgcgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 58 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPARYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 59 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaagactgatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtcaaccgcgtcgatctgactgtggtgggctttgaagaaggtaaggaaggtaccaagaatgaaggcgttctgggtgcactggtcgtcgagtataaaggcaacgaagtttctattggcggtggatatacggacgagatgcgtgtggatctttgggctcgccgcaatgaactgatcaacaaagtgattgagattgaataccgtgaagaaagcacatcatcgaagaccggcaagaaatctttacgtttcccggagtttgttcgctttcgtccggacaaagag

SEQ ID NO: 60 - protein, 437 aa, synthetic construct
  REGION 1..437: note = Engineered DNA ligase variant
MHHHHHHGGSGMTKQIVQAFELLEAIGGTTSRTAKTDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 61 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 62 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 63 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgaaagattctttagcagtctttctgtcagactgcggccagaaagaagccgagtggtatatgaaaagcattcagaaagactttcgtattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtccagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtcaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggcaagaaatctttacgtttcccggagtttgttcgctttcgtccggacaaagag

SEQ ID NO: 64 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAAKDSLAVFLSDCGQKEAEWYMKSIQKDFRIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 65 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgaaagattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtcaaccgcgtcgatctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccggagtttgttcgctttcgtccggacaaagag

SEQ ID NO: 66 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAAKDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPEFVRFRPDKE

SEQ ID NO: 67 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaaggagattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 68 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKEITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 69 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaaccggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 70 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKPGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 71 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttggacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 72 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSLDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 73 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtagggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 74 - protein, 437 aa, synthetic construct
  REGION 1..437: note = Engineered DNA ligase variant
MHHHHHHGGSGMTKQIVQAFELLEAIGGTTSRRAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 75 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtgtggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 76 - protein, 437 aa, synthetic construct
  REGION 1..437: note = Engineered DNA ligase variant
MHHHHHHGGSGMTKQIVQAFELLEAIGGTTSRVAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 77 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagaccagcagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 78 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDQQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 79 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccccggacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 80 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSPDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 81 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcacttgtagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 82 - protein, 437 aa, synthetic construct
  REGION 1..437: note = Engineered DNA ligase variant
MHHHHHHGGSGMTKQIVQAFELLEAIGGTCSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 83 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaatgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 84 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGNEGTKNEGVLGALVVEYKGNEVSIGGGYTDEMRVDLWARRNELINKVIEIEYREESTSSKTGKKSLRFPRFVRFRPDKE

SEQ ID NO: 85 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccggggacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 86 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSGDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 87 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtcgccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 88 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQESPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 89 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 90 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 91 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcgcttcatcgaagaccggtaagaaatctttacgtttcccgcgttttgttcgctttcgtccggacaaagag

SEQ ID NO: 92 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESASSKTGKKSLRFPRFVRFRPDKE

SEQ ID NO: 93 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatggtgacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 94 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYGDEMRVDLWARRNELINKVIEIEYREESTSSKTGKKSLRFPRFVRFRPDKE

SEQ ID NO: 95 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagccattcatcgaagaccggtaagaaatctttacgtttcccgcgttttgttcgctttcgtccggacaaagag

SEQ ID NO: 96 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESHSSKTGKKSLRFPRFVRFRPDKE

SEQ ID NO: 97 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgcggtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 98 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNAVSIGGGYTDEMRVDLWARRNELINKVIEIEYREESTSSKTGKKSLRFPRFVRFRPDKE

SEQ ID NO: 99 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaaggtgatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 100 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEGDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 101 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaatggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 102 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGMVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 103 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccatggacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 104 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSMDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 105 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggaccagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 106 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDQMRVDLWARRNELINKVIEIEYREESTSSKTGKKSLRFPRFVRFRPDKE

SEQ ID NO: 107 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtttggcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 108 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGLAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 109 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacctgatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 110 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDLMRVDLWARRNELINKVIEIEYREESTSSKTGKKSLRFPRFVRFRPDKE

SEQ ID NO: 111 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtagggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 112 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 113 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 114 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 115 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccggcgcgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 116 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPARYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 117 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcgagtcatcgaagaccggtaagaaatctttacgtttcccgcgttttgttcgctttcgtccggacaaagag

SEQ ID NO: 118 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESESSKTGKKSLRFPRFVRFRPDKE

SEQ ID NO: 119 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagctttgagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 120 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSFESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 121 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactcatagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 122 - protein, 437 aa, synthetic construct
  REGION 1..437: note = Engineered DNA ligase variant
MHHHHHHGGSGMTKQIVQAFELLEAIGGTHSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 123 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacggggtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 124 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNGVSIGGGYTDEMRVDLWARRNELINKVIEIEYREESTSSKTGKKSLRFPRFVRFRPDKE

SEQ ID NO: 125 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtggaaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 126 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEWKGNEVSIGGGYTDEMRVDLWARRNELINKVIEIEYREESTSSKTGKKSLRFPRFVRFRPDKE

SEQ ID NO: 127 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagtggcgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 128 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEWRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 129 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaaacgtctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 130 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNETSIGGGYTDEMRVDLWARRNELINKVIEIEYREESTSSKTGKKSLRFPRFVRFRPDKE

SEQ ID NO: 131 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagctgttcatcgaagaccggtaagaaatctttacgtttcccgcgttttgttcgctttcgtccggacaaagag

SEQ ID NO: 132 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESCSSKTGKKSLRFPRFVRFRPDKE

SEQ ID NO: 133 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatcggggagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 134 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIGEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 135 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaacggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 136 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGTVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 137 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 138 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 139 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgacgatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaaactattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagccgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcaggcaagaccggtaagaaatctttacgtttcccgcgttttgttcgctttcgtccggacaaagag

SEQ ID NO: 140 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDDGNLQDNYISYLDLTSKLYNRELTGNAALDSLAVFLSDCGQKEAEWYMKSIQKDFKIGITAKTINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSGKTGKKSLRFPRFVRFRPDKE

SEQ ID NO: 141 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgaaggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagccgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcaggcaagaccggtaagaaatctttacgtttcccgcgttttgttcgctttcgtccggacaaagag

SEQ ID NO: 142 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAAKDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSGKTGKKSLRFPRFVRFRPDKE

SEQ ID NO: 143 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagccgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgaactgactgtggtgggctttgaagaaggtaaagaaggtggtaagaatgaaggcgttctgggtgcactggtcgtcgagtataaaggcaacgaagtttctattggcggtggatttacggacgagatgcgtgtggatctttgggctcgccgcaatgaactgatcaacaaagtgattgagattgaataccgtgaagaaagcacatcaagcaagaccggtaagaaatctttacgtttcccgcgttttgttcgctttcgtccggacaaagag

SEQ ID NO: 144 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVELTVVGFEEGKEGGKNEGVLGALVVEYKGNEVSIGGGFTDEMRVDLWARRNELINKVIEIEYREESTSSKTGKKSLRFPRFVRFRPDKE

SEQ ID NO: 145 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgaaggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 146 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAAKDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 147 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaaactattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtggtaagaatgaaggcgttctgggtgcactggtcgtcgagtataaaggcaacgaagtttctattggcggcggatatacggacgagatgcgtgtggatctttgggctcgccgcaatgaactgatcaataaagttattgagatcgaataccgtgaagaaagcacatcatcgaagaccggtaagaaatctttacgtttcccgcgttttgttcgctttcgtccggacaaagag

SEQ ID NO: 148 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKTINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGGKNEGVLGALVVEYKGNEVSIGGGYTDEMRVDLWARRNELINKVIEIEYREESTSSKTGKKSLRFPRFVRFRPDKE

SEQ ID NO: 149 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaactgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaataaaattattgagatcgaataccgtgaagaaagcacatcaagcaagaccggtaagaaatctttacgtttcccgcgttttgttcgctttcgtccggacaaagag

SEQ ID NO: 150 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKTAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKIIEIEYREESTSSKTGKKSLRFPRFVRFRPDKE

SEQ ID NO: 151 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaaactattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 152 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKTINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 153 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatggccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 154 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKWPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 155 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagaggttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 156 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEVPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 157 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgcttagtaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 158 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLSNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 159 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacttacatcatcgaagaccggtaagaaatctttacgtttcccgcgttttgttcgctttcgtccggacaaagag

SEQ ID NO: 160 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREELTSSKTGKKSLRFPRFVRFRPDKE

SEQ ID NO: 161 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcattgaagaccggtaagaaatctttacgtttcccgcgttttgttcgctttcgtccggacaaagag

SEQ ID NO: 162 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSLKTGKKSLRFPRFVRFRPDKE

SEQ ID NO: 163 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggctcttttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 164 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGSFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 165 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacgtacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 166 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 167 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggccagtttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 168 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGQFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 169 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgtctgattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 170 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAASDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 171 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 172 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 173 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacatgcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 174 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADMQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 175 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctggtgtacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 176 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLVYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 177 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagtggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 178 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGVVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 179 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacttgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 180 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGLVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 181 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacccggtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 182 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNPVSIGGGYTDEMRVDLWARRNELINKVIEIEYREESTSSKTGKKSLRFPRFVRFRPDKE

SEQ ID NO: 183 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcgtgtcatcgaagaccggtaagaaatctttacgtttcccgcgttttgttcgctttcgtccggacaaagag

SEQ ID NO: 184 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESVSSKTGKKSLRFPRFVRFRPDKE

SEQ ID NO: 185 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcatttcatcgaagaccggtaagaaatctttacgtttcccgcgttttgttcgctttcgtccggacaaagag

SEQ ID NO: 186 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESISSKTGKKSLRFPRFVRFRPDKE

SEQ ID NO: 187 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 188 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 189 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagaggccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 190 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQERPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 191 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcgtgtttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 192 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGVFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 193 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgcttaccggtaagaaatctttacgtttcccgcgttttgttcgctttcgtccggacaaagag

SEQ ID NO: 194 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 195 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgtcgaccggtaagaaatctttacgtttcccgcgttttgttcgctttcgtccggacaaagag

SEQ ID NO: 196 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 197 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgggctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 198 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGGLVVEYKGNEVSIGGGYTDEMRVDLWARRNELINKVIEIEYREESTSSKTGKKSLRFPRFVRFRPDKE

SEQ ID NO: 199 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagaggcgccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 200 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEAPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 201 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctcctcggacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 202 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSSDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 203 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgtgggaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 204 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVWEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 205 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagagttcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 206 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKSSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 207 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgagttttgttcgctttcgtccggacaaagag

SEQ ID NO: 208 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPSFVRFRPDKE

SEQ ID NO: 209 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 210 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 211 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtgggaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 212 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGGKNEGVLGALVVEYKGNEVSIGGGYTDEMRVDLWARRNELINKVIEIEYREESTSSKTGKKSLRFPRFVRFRPDKE

SEQ ID NO: 213 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagaggggccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 214 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEGPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 215 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaaggtgattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 216 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKVITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 217 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagctttcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 218 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKLSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 219 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcctgtcatcgaagaccggtaagaaatctttacgtttcccgcgttttgttcgctttcgtccggacaaagag

SEQ ID NO: 220 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESLSSKTGKKSLRFPRFVRFRPDKE

SEQ ID NO: 221 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaatgggccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 222 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKWAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 223 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaaacggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 224 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKTGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 225 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagaccgtcagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 226 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDRQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 227 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgcctggaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 228 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAWKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 229 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttcctgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 230 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLPAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 231 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatcagtgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 232 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPISEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 233 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtggggcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 234 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGGAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 235 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgacggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 236 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAATDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 237 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcttggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 238 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSLESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 239 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttttaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 240 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLFNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 241 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactggtgggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 242 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELVGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 243 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagtattcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 244 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKYSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 245 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcacttcgagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 246 - protein, 437 aa, synthetic construct
  REGION 1..437: note = Engineered DNA ligase variant
MHHHHHHGGSGMTKQIVQAFELLEAIGGTSSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 247 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgttttttgttcgctttcgtccggacaaagag

SEQ ID NO: 248 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPFFVRFRPDKE

SEQ ID NO: 249 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgaagaccggtaagaaatctttacgtttcccgcgttttgttcgctttcgtccggacaaagag

SEQ ID NO: 250 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSKTGKKSLRFPRFVRFRPDKE

SEQ ID NO: 251 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaagttacatcatcgaagaccggtaagaaatctttacgtttcccgcgttttgttcgctttcgtccggacaaagag

SEQ ID NO: 252 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEVTSSKTGKKSLRFPRFVRFRPDKE

SEQ ID NO: 253 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagttgccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 254 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 255 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaagctacatcatcgaagaccggtaagaaatctttacgtttcccgcgttttgttcgctttcgtccggacaaagag

SEQ ID NO: 256 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEATSSKTGKKSLRFPRFVRFRPDKE

SEQ ID NO: 257 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacggacatcatcgaagaccggtaagaaatctttacgtttcccgcgttttgttcgctttcgtccggacaaagag

SEQ ID NO: 258 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREERTSSKTGKKSLRFPRFVRFRPDKE

SEQ ID NO: 259 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggttgtctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 260 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSKTGKKSLRFPRFVRFRPDKE

SEQ ID NO: 261 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagaagccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 262 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEKPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 263 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgcttttgaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 264 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLLNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 265 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacatgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 266 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 267 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcagataagaccggtaagaaatctttacgtttcccgcgttttgttcgctttcgtccggacaaagag

SEQ ID NO: 268 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSDKTGKKSLRFPRFVRFRPDKE

SEQ ID NO: 269 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcgattttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 270 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGDFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 271 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaggggccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 272 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKGAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 273 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagtatcgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 274 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEYRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 275 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaacggggaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 276 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNGELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 277 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcgagtttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 278 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGEFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 279 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 280 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSTTGKKSLRFPRFVRFRPDKE

SEQ ID NO: 281 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacttgcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 282 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADLQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 283 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaacgacatcatcgaagaccggtaagaaatctttacgtttcccgcgttttgttcgctttcgtccggacaaagag

SEQ ID NO: 284 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREETTSSKTGKKSLRFPRFVRFRPDKE

SEQ ID NO: 285 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcggcgaccggtaagaaatctttacgtttcccgcgttttgttcgctttcgtccggacaaagag

SEQ ID NO: 286 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSATGKKSLRFPRFVRFRPDKE

SEQ ID NO: 287 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaaggtttcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 288 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKVSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 289 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcggggaccggtaagaaatctttacgtttcccgcgttttgttcgctttcgtccggacaaagag

SEQ ID NO: 290 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSGTGKKSLRFPRFVRFRPDKE

SEQ ID NO: 291 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctgttggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 292 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSVGGGYTDEMRVDLWARRNELINKVIEIEYREESTSSKTGKKSLRFPRFVRFRPDKE

SEQ ID NO: 293 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggaggatcgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 294 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEDRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 295 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagatgccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 296 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEMPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 297 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgcctaccggtaagaaatctttacgtttcccgcgttttgttcgctttcgtccggacaaagag

SEQ ID NO: 298 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSPTGKKSLRFPRFVRFRPDKE

SEQ ID NO: 299 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagcggtcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 300 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKRSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 301 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagatgtcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 302 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKMSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 303 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgattaccggtaagaaatctttacgtttcccgcgttttgttcgctttcgtccggacaaagag

SEQ ID NO: 304 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSITGKKSLRFPRFVRFRPDKE

SEQ ID NO: 305 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaatgtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 306 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEECKEGTKNEGVLGALVVEYKGNEVSIGGGYTDEMRVDLWARRNELINKVIEIEYREESTSSKTGKKSLRFPRFVRFRPDKE

SEQ ID NO: 307 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacgggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 308 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGRVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 309 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgatgaccggtaagaaatctttacgtttcccgcgttttgttcgctttcgtccggacaaagag

SEQ ID NO: 310 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSMTGKKSLRFPRFVRFRPDKE

SEQ ID NO: 311 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtagtgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagcgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgccacaggttatgaagggacgatgattaaagatttagacgcgacctacaaatgcaaacgctccttcgacatccaaaagatcgttgatgtaaaccgcgtcgatctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 312 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGSAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRATGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 313 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaacaagggattctgcatatctttgatgctgttccaatccacgagtttgaagcgggagaatcgacccgcattctggagcaacgtattaatttcttacgcgaagtagacgaacagtacattcaagaggttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 314 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQEVPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSLTGKKSLRFPRFVRFRPDKE

SEQ ID NO: 315 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 316 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 317 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 318 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 319 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaagggattctgcatatctttgatgctgttccaatccacgagtttgaagcgggagaatcgacccgcattctggagcaacgtattaatttcttacgcgaagtagacgaacagtacattcaagaggttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 320 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKQGILHIFDAVPIHEFEAGESTRILEQRINFLREVDEQYIQEVPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 321 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgagcagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 322 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKKSDDKVGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 323 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagaggttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 324 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEVPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 325 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagatcattacgggttacaccggcatcgaacaggatatcgcccagttgcccgtcggctttatgtatgacggtgaaattatggcgccgtccggcaaatttgcagacgttcagaaaagtgccttcaagaagtcagatgataaaccagggattctgcatatctttgatgctgttccaatccacgagtttgaagcgggagaatcgacccgcattctggagcaacgtattaatttcttacgcgaagtagacgagcagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 326 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKPGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSTTGKKSLRFPRFVRFRPDKE

SEQ ID NO: 327 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 328 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEKDIAQLPVGFMYDGEIMAPSGKFADVQKSAFKKSDDKTGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 329 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 330 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 331 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagaccagcagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaacgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 332 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDQQYIQEFPLSNLEWVQPDGVFEDSEESQQEVFHLHRHNRAQGYEGTMIKDLDATYKCKRSFDIQKIVDVNRVDLTVVGFEEGNEGTKNEGVLGALVVEYKGNEVSIGGGYTDEMRVDLWARRNELINKVIEIEYREESTSSTTGKKSLRFPRFVRFRPDKE

SEQ ID NO: 333 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagaggttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 334 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEKDIAQLPVGFMYDGEIMAPSGKFADVQKSAFKKSDDKVGILHIFDAVPIHEFEAGESTRILEQRINFLREVDEQYIQEVPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 335 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaagtcagatgataaacaagggattctgcatatctttgatgctgttccaatccacgagtttgaagcgggagaatcgacccgcattctggagcaacgtattaatttcttacgcgaagtagaccagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 336 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDQQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 337 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaacaagggattctgcatatctttgatgctgttccaatccacgagtttgaagcgggagaatcgacccgcattctggagcaacgtattaatttcttacgcgaagtagacgaacagtacattcaagagagtccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 338 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQESPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSTTGKKSLRFPRFVRFRPDKE

SEQ ID NO: 339 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttatgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaaggtaattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggaccagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 340 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFMSDCGQKEAEWYMKSIQKDFKIGITAKSINKVIPCLIAEYSCALAKPLKKYPKRYSADRKLDGYRCNGFNYGGGKVVLKSRNGKVITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDQMRVDLWARRNELINKVIEIEYREESTSSKTGKKSLRFPRFVRFRPDKE

SEQ ID NO: 341 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagacgagcagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 342 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 343 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaaccagggattctgcatatctttgatgctgttccaatccacgagtttgaagcgggagaatcgacccgcattctggagcaacgtattaatttcttacgcgaagtagacgagcagtacattcaagagcgtccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 344 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKPGILHIFDAVPIHEFEAGESTRILEQRINFLREVDEQYIQERPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSLTGKKSLRFPRFVRFRPDKE

SEQ ID NO: 345 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagatcattacgggttacaccggcatcgaacaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 346 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 347 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaacaagggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaacgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 348 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGNEGTKNEGVLGALVVEYKGNEVSIGGGYTDEMRVDLWARRNELINKVIEIEYREESTSSSTGKKSLRFPRFVRFRPDKE

SEQ ID NO: 349 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 350 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 351 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaaatcagatgataaagttgggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 352 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 353 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaaacggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 354 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKKSDDKTGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 355 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagatcattacgggttacaccggcatcgaaaaggatatcgcccagttgcccgtcggctttatgtatgacggtgaaattatggcgccgtccggcaaatttgcagacgttcagaaaagtgccttcaagaagtcagatgataaacaagggattctgcatatctttgatgctgttccaatccacgagtttgaagcgggagaatcgacccgcattctggagcaacgtattaatttcttacgcgaagtagacgaacagtacattcaagagagtccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 356 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEKDIAQLPVGFMYDGEIMAPSGKFADVQKSAFKKSDDKQGILHIFDAVPIHEFEAGESTRILEQRINFLREVDEQYIQESPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 357 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagatcattacgggttacaccggcatcgaaaaggatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagacgagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaacgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 358 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGNEGTKNEGVLGALVVEYKGNEVSIGGGYTDEMRVDLWARRNELINKVIEIEYREESTSSLTGKKSLRFPRFVRFRPDKE

SEQ ID NO: 359 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 360 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEKDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 361 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgaacagtacattcaagaggttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 362 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKTGILHIFDAVPIHEFEAGESTRILEQRINFLREVDEQYIQEVPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 363 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 364 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 365 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaagtcagatgataaaccagggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 366 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKPGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 367 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagaggttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 368 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEVPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 369 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaaacggggattctgcatatctttgatgctgttccaatccacgagtttgaagcgggagaatcgacccgcattctggagcaacgtattaatttcttacgcgaagtagacgagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 370 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKTGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 371 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 372 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSLTGKKSLRFPRFVRFRPDKE

SEQ ID NO: 373 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagaccagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 374 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDQQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 375 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggcgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagacgaacagtacattcaagaggttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 376 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVALKSRNGKIITGYTGIEQDIAQLPVGFMYDGEIMAPSGKFADVQKSAFKKSDDKVGILHIFDAVPIHEFEAGESTRILEQRINFLREVDEQYIQEVPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 377 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 378 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 379 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaaatcagatgataaaacggggattctgcatatctttgatgctgttccaatccacgagtttgaagcgggagaatcgacccgcattctggagcaacgtattaatttcttacgcgaagtagacgagcagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaacgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 380 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKTGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGNEGTKNEGVLGALVVEYKGNEVSIGGGYTDEMRVDLWARRNELINKVIEIEYREESTSSLTGKKSLRFPRFVRFRPDKE

SEQ ID NO: 381 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 382 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 383 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaagtcagatgataaaccagggattctgcatatctttgatgctgttccaatccacgagtttgaagcgggagaatcgacccgcattctggagcaacgtattaatttcttacgcgaagtagacgaacagtacattcaagaggttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 384 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKPGILHIFDAVPIHEFEAGESTRILEQRINFLREVDEQYIQEVPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 385 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagttgggattctgcatatctttgatgctgttccaatccacgagtttgaagcgggagaatcgacccgcattctggagcaacgtattaatttcttacgcgaagtagaccagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 386 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEQRINFLREVDQQYIQEFPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 387 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaagtcagatgataaacaagggattctgcatatctttgatgctgttccaatccacgagtttgaagcgggagaatcgacccgcattctggagcaacgtattaatttcttacgcgaagtagacgaacagtacattcaagagcgtccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 388 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQERPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 389 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 390 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 391 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcacttgcagccgtaccgccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgtgggaagatagcgaagagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtacaaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 392 - protein, 437 aa, synthetic construct
  REGION 1..437: note = Engineered DNA ligase variant
MHHHHHHGGSGMTKQIVQAFELLEAIGGTCSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVWEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 393 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 394 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 395 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagatcattacgggttacaccggcatcgaacaggatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagacgagcagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 396 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 397 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 398 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSTTGKKSLRFPRFVRFRPDKE

SEQ ID NO: 399 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaaacggggattctgcatatctttgatgctgttccaatccacgagtttgaagcgggagaatcgacccgcattctggagcaacgtattaatttcttacgcgaagtagacgaacagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 400 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKKSDDKTGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 401 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaacgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 402 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEKDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGNEGTKNEGVLGALVVEYKGNEVSIGGGYTDEMRVDLWARRNELINKVIEIEYREESTSSTTGKKSLRFPRFVRFRPDKE

SEQ ID NO: 403 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaagtcagatgataaagttgggattctgcatatctttgatgctgttccaatccacgagtttgaagcgggagaatcgacccgcattctggagcaacgtattaatttcttacgcgaagtagacgagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 404 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 405 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgaacagtacattcaagagagtccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 406 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKTGILHIFDAVPIHEFEAGESTRILEQRINFLREVDEQYIQESPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 407 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 408 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 409 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgagcagtacattcaagagtttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 410 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKTGILHIFDAVPIHEFEAGESTRILEQRINFLREVDEQYIQEFPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 411 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 412 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 413 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtaccgccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacctgcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgtttgaagatagcgaagagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtacaaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 414 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADLQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 415 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtgtagccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgtgggaagatagcgaagagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 416 - protein, 437 aa, synthetic construct
  REGION 1..437: note = Engineered DNA ligase variant
MHHHHHHGGSGMTKQIVQAFELLEAIGGTTSRVAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVWEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 417 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 418 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEKDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 419 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgagcagtacattcaagagctgccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 420 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 421 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 422 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 423 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagaccagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 424 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDQQYIQEFPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 425 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgaacagtacattcaagagcgtccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 426 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKKSDDKTGILHIFDAVPIHEFEAGESTRILEQRINFLREVDEQYIQERPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSLTGKKSLRFPRFVRFRPDKE

SEQ ID NO: 427 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 428 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSTTGKKSLRFPRFVRFRPDKE

SEQ ID NO: 429 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtgtagccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtggaaaggcaacgaagtttctattggcggcggatatacggaccagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 430 - protein, 437 aa, synthetic construct
  REGION 1..437: note = Engineered DNA ligase variant
MHHHHHHGGSGMTKQIVQAFELLEAIGGTTSRVAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEWKGNEVSIGGGYTDQMRVDLWARRNELINKVIEIEYREESTSSKTGKKSLRFPRFVRFRPDKE

SEQ ID NO: 431 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtcgcgccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacctgcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtacaaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 432 - protein, 437 aa, synthetic construct
  REGION 1..437: note = Engineered DNA ligase variant
MHHHHHHGGSGMTKQIVQAFELLEAIGGTTSRRAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADLQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 433 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaaggaaattacgggttacaccggcatcgaacaggatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgaacagtacattcaagaggttccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 434 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKEITGYTGIEQDIAQLPVGFMYDGEIMAPSGKFADVQKSAFKKSDDKTGILHIFDAVPIHEFEAGESTRILEQRINFLREVDEQYIQEVPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSTTGKKSLRFPRFVRFRPDKE

SEQ ID NO: 435 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgaacagtacattcaagagctgccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 436 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKTGILHIFDAVPIHEFEAGESTRILEQRINFLREVDEQYIQELPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSSTGKKSLRFPRFVRFRPDKE

SEQ ID NO: 437 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 438 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 439 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtgtagccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaaggtaattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgtttgaagatagcgaagagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 440 - protein, 437 aa, synthetic construct
  REGION 1..437: note = Engineered DNA ligase variant
MHHHHHHGGSGMTKQIVQAFELLEAIGGTTSRVAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKVITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 441 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtcgcgccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgttcgaagatagcgaagagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtggaaaggcaacgaagtttctattggcggcggatatacggaccagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 442 - protein, 437 aa, synthetic construct
  REGION 1..437: note = Engineered DNA ligase variant
MHHHHHHGGSGMTKQIVQAFELLEAIGGTTSRRAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEWKGNEVSIGGGYTDQMRVDLWARRNELINKVIEIEYREESTSSKTGKKSLRFPRFVRFRPDKE

SEQ ID NO: 443 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagaccagcagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 444 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEQRINFLREVDQQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 445 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagatcattacgggttacaccggcatcgaacaagatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgctgaccggtaagaaatctttacgtttcccgcgttttgttcgctttcgtccggacaaagag

SEQ ID NO: 446 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKTGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSLTGKKSLRFPRFVRFRPDKE

SEQ ID NO: 447 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 448 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKTGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 449 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtgtagccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaaggtaattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgtgggaagatagctttgagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 450 - protein, 437 aa, synthetic construct
  REGION 1..437: note = Engineered DNA ligase variant
MHHHHHHGGSGMTKQIVQAFELLEAIGGTTSRVAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKVITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVWEDSFESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSKTGKKSLRFPRFVRFRPDKE

SEQ ID NO: 451 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaggtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagtattcagatgataaaccagggattctgcatatctttgatgctgttccaatccacgagtttgaagcgggagaatcgacccgcattctggagcaacgtattaatttcttacgcgaagtagacgagcagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 452 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEKDIAQLPVGFMYDGEIMAPSGKFADVQKSAFKYSDDKPGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSKTGKKSLRFPRFVRFRPDKE

SEQ ID NO: 453 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaaaaggatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgcgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 454 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEKDIAQLPVGFMYDGEIMAPSGKFADVQKSAFKKSDDKVGILHIFDAVPIHEFEAGESTRILEQRINFLREVDEQYIQELPLWNLEWVQPDGVFEDSEESQQEVFHLHRHNRAQGYEGTMIKDLDATYKCKRSFDIQKIVDVNRVDLTVVGFEEGREGTKNEGVLGALVVEYKGNEVSIGGGYTDEMRVDLWARRNELINKVIEIEYREESTSSTTGKKSLRFPRFVRFRPDKE

SEQ ID NO: 455 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtgtagccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagcagcgtattaatttcttacgcgaagtagacgaacagtacattcaagagtttccgctttggaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaagaaggtaccaagaatgaaggcgttctgggtgcactggtcgtcgagtataaaggcaacgaagtttctattggcggcggatatacggaccagatgcgtgtggatctttgggctcgccgcaatgaactgatcaacaaagtgattgagattgaataccgtgaagaaagcacatcatcgaagaccggtaagaaatctttacgtttcccgcgttttgttcgctttcgtccggacaaagag

SEQ ID NO: 456 - protein, 437 aa, synthetic construct
  REGION 1..437: note = Engineered DNA ligase variant
MHHHHHHGGSGMTKQIVQAFELLEAIGGTTSRVAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQEFPLWNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDQMRVDLWARRNELINKVIEIEYREESTSSKTGKKSLRFPRFVRFRPDKE

SEQ ID NO: 457 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaaggaaattacgggttacaccggcatcgaacaagatatcgcccagttgcccgtcggctttatgtatgacggtgaaattatggcgccgtccggcaaatttgcagacgttcagaaaagtgccttcaagaagtcagatgataaaacggggattctgcatatctttgatgctgttccaatccacgagtttgaagcgggagaatcgacccgcattctggagcaacgtattaatttcttacgcgaagtagacgagcagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaacgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgacgaccggtaagaaatctttacgtttcccgcgttttgttcgctttcgtccggacaaagag

SEQ ID NO: 458 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKEITGYTGIEQDIAQLPVGFMYDGEIMAPSGKFADVQKSAFKKSDDKTGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGNEGTKNEGVLGALVVEYKGNEVSIGGGYTDEMRVDLWARRNELINKVIEIEYREESTSSTTGKKSLRFPRFVRFRPDKE

SEQ ID NO: 459 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtacccgcaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 460 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTRNEGVLGALVVEYKGNEVSIGGGYTDEMRVDLWARRNELINKVIEIEYREESTSSSTGKKSLRFPRFVRFRPDKE

SEQ ID NO: 461 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 462 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 463 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacaaaatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 464 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDKMRVDLWARRNELINKVIEIEYREESTSSSTGKKSLRFPRFVRFRPDKE

SEQ ID NO: 465 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagttcgcattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 466 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVRIGGGYTDEMRVDLWARRNELINKVIEIEYREESTSSSTGKKSLRFPRFVRFRPDKE

SEQ ID NO: 467 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggaccgcatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 468 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDRMRVDLWARRNELINKVIEIEYREESTSSSTGKKSLRFPRFVRFRPDKE

SEQ ID NO: 469 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattcgcacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 470 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIRTGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 471 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtcgtgaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 472 - protein, 437 aa, synthetic construct; identical to SEQ ID NO: 346
  REGION 1..437: note = Engineered DNA ligase variant

SEQ ID NO: 473 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagttaaaattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 474 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVKIGGGYTDEMRVDLWARRNELINKVIEIEYREESTSSSTGKKSLRFPRFVRFRPDKE

SEQ ID NO: 475 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaaagcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 476 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGKAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 477 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaaaaatattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 478 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKKYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 479 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacgaaagagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 480 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTKEMRVDLWARRNELINKVIEIEYREESTSSSTGKKSLRFPRFVRFRPDKE

SEQ ID NO: 481 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacgtacatcatcgagcaccggtaagaaatctttacgtttcccgcgttttgttcgctttcgtccggacaaagag

SEQ ID NO: 482 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREERTSSSTGKKSLRFPRFVRFRPDKE

SEQ ID NO: 483 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctcccgcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 484 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSRDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 485 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgcgtcgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 486 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPRRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 487 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacaaaatcgagcaccggtaagaaatctttacgtttcccgcgttttgttcgctttcgtccggacaaagag

SEQ ID NO: 488 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTKSSTGKKSLRFPRFVRFRPDKE

SEQ ID NO: 489 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgacccgcaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 490 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTRNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 491 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcaaatcatcgagcaccggtaagaaatctttacgtttcccgcgttttgttcgctttcgtccggacaaagag

SEQ ID NO: 492 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESKSSSTGKKSLRFPRFVRFRPDKE

SEQ ID NO: 493 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaacgcttacgtttcccgcgttttgttcgctttcgtccggacaaagag

SEQ ID NO: 494 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKRLRFPRFVRFRPDKE

SEQ ID NO: 495 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagcgtgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 496 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKREGVLGALVVEYKGNEVSIGGGYTDEMRVDLWARRNELINKVIEIEYREESTSSSTGKKSLRFPRFVRFRPDKE

SEQ ID NO: 497 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgccgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 498 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSPPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 499 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaaattattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 500 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKIILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 501 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcctgtcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 502 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKILSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 503 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacgtacgagatgcgtgtggatctttgggctcgccgcaatgaactgatcaacaaagtgattgagattgaataccgtgaagaaagcacatcatcgagcgggggtaagaaatctttacgtttcccgcgttttgttcgctttcgtccggacaaagag

SEQ ID NO: 504 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTYEMRVDLWARRNELINKVIEIEYREESTSSSGGKKSLRFPRFVRFRPDKE

SEQ ID NO: 505 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagggattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 506 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKGILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 507 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaaaagggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 508 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEKGKEGTKNEGVLGALVVEYKGNEVSIGGGYTDEMRVDLWARRNELINKVIEIEYREESTSSSTGKKSLRFPRFVRFRPDKE

SEQ ID NO: 509 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttggcatcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 510 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWHRRNELINKVIEIEYREESTSSSTGKKSLRFPRFVRFRPDKE

SEQ ID NO: 511 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagtataagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 512 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKYKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 513 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccttttatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 514 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTFYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 515 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcccgtcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 516 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIPSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 517 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccgtgcagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 518 - protein, 437 aa, synthetic construct
  REGION 1..437: note = Engineered DNA ligase variant
MHHHHHHGGSGMTVQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 519 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatgggttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 520 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINGLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 521 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaaggctaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 522 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKAKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 523 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatgaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 524 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKMKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 525 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaagccgggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 526 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKPGTKNEGVLGALVVEYKGNEVSIGGGYTDEMRVDLWARRNELINKVIEIEYREESTSSSTGKKSLRFPRFVRFRPDKE

SEQ ID NO: 527 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctgatgcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 528 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILMQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 529 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgatcagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 530 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIDQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 531 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttatctaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 532 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLSTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 533 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgaccactattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 534 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTTILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 535 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgctgtctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 536 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRCLEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 537 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaggaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 538 - protein, 437 aa, synthetic construct
  REGION 1..437: note = Engineered DNA ligase variant
MHHHHHHGGSGMRKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 539 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgaccttgattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 540 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTLILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 541 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaagatgggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 542 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKMGTKNEGVLGALVVEYKGNEVSIGGGYTDEMRVDLWARRNELINKVIEIEYREESTSSSTGKKSLRFPRFVRFRPDKE

SEQ ID NO: 543 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcacggaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 544 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGTEVSIGGGYTDEMRVDLWARRNELINKVIEIEYREESTSSSTGKKSLRFPRFVRFRPDKE

SEQ ID NO: 545 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaacccattatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 546 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTHYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 547 - DNA, 1311 bp, synthetic construct
  misc_feature 1..1311: note = Engineered DNA ligase variant
  source 1..1311: mol_type = other DNA
atgcaccatcatcatcatcatggcggtagcggcatggggaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 548 - protein, 437 aa, synthetic construct
  REGION 1..437: note = Engineered DNA ligase variant
MHHHHHHGGSGMGKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 549 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaacccggtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 550 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTRYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 551 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaaactattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 552 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKTILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 553 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactgcaggtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 554 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALQVEYKGNEVSIGGGYTDEMRVDLWARRNELINKVIEIEYREESTSSSTGKKSLRFPRFVRFRPDKE

SEQ ID NO: 555 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaaagtattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 556 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKSILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 557 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatggtgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 558 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDGEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 559 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgactccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 560 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSTPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 561 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctcttggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 562 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPLGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 563 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactgaatgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 564 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALNVEYKGNEVSIGGGYTDEMRVDLWARRNELINKVIEIEYREESTSSSTGKKSLRFPRFVRFRPDKE

SEQ ID NO: 565 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccaattatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 566 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTNYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 567 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaacttgtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 568 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLELVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 569 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctttgcgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 570 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWALRNELINKVIEIEYREESTSSSTGKKSLRFPRFVRFRPDKE

SEQ ID NO: 571 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccggttatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 572 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTGYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 573 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgcttaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 574 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLLNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 575 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaattgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 576 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFELGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 577 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaaggtttacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 578 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKVYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 579 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccatgggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 580 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPMGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 581 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattgttggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 582 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIIVGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 583 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccctgtcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 584 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITALSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 585 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttgatgcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 586 - protein, 437 aa, synthetic construct
  REGION 1..437: note = Engineered DNA ligase variant
MHHHHHHGGSGMTKQIVDAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 587 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgtttcggcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 588 - protein, 437 aa, synthetic construct
  REGION 1..437: note = Engineered DNA ligase variant
MHHHHHHGGSGMTKQIVSAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 589 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaactctgtgattgagattgaataccgtgaagaaagcacatcatcgagcaccggtaagaaatctttacgtttcccgcgttttgttcgctttcgtccggacaaagag

SEQ ID NO: 590 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINSVIEIEYREESTSSSTGKKSLRFPRFVRFRPDKE

SEQ ID NO: 591 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttaggggaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 592 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLGEVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 593 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggcgggaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 594 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGGKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 595 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgagaaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 596 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDEKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 597 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagtcgaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 598 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKSKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 599 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgtgtccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 600 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSCPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 601 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcactatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 602 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKITIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 603 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaagagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 604 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEEYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 605 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaagcatggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 606 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKHGTKNEGVLGALVVEYKGNEVSIGGGYTDEMRVDLWARRNELINKVIEIEYREESTSSSTGKKSLRFPRFVRFRPDKE

SEQ ID NO: 607 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattgatggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 608 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIIDGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 609 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatacggaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 610 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDTEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 611 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagcgttacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 612 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKRYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 613 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgaagccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 614 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSKPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 615 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggtgtgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 616 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLVWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 617 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcagcgtaattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 618 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQRNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 619 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttaagggcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 620 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLRATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 621 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 622 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSDSTGKKSLRFPRFVRFRPDKE

SEQ ID NO: 623 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 624 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSLSTGKKSLRFPRFVRFRPDKE

SEQ ID NO: 625 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 626 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 627 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 628 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 629 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 630 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSLSTGKKSLRFPRFVRFRPDKE

SEQ ID NO: 631 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 632 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 633 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 634 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSDSTGKKSLRFPRFVRFRPDKE

SEQ ID NO: 635 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 636 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSDSTGKKSLRFPRFVRFRPDKE

SEQ ID NO: 637 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctgtcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 638 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSVGGGYTDEMRVDLWARRNELINKVIEIEYREESTSSSTGKKSLRFPRFVRFRPDKE

SEQ ID NO: 639 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 640 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSDSTGKKSLRFPRFVRFRPDKE

SEQ ID NO: 641 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 642 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 643 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 644 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSDSTGKKSLRFPRFVRFRPDKE

SEQ ID NO: 645 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 646 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 647 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 648 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSLSTGKKSLRFPRFVRFRPDKE

SEQ ID NO: 649 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 650 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKRSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 651 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 652 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKRSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSLSTGKKSLRFPRFVRFRPDKE

SEQ ID NO: 653 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 654 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSLSTGKKSLRFPRFVRFRPDKE

SEQ ID NO: 655 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 656 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 657 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 658 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 659 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 660 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSDSTGKKSLRFPRFVRFRPDKE

SEQ ID NO: 661 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctgtcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 662 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSVGGGYTDEMRVDLWARRNELINKVIEIEYREESTSSSTGKKSLRFPRFVRFRPDKE

SEQ ID NO: 663 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctgtcggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 664 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSVGGGYTDEMRVDLWARRNELINKVIEIEYREESTSDSTGKKSLRFPRFVRFRPDKE

SEQ ID NO: 665 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggcaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 666 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSDSTGKKSLRFPRFVRFRPDKE

SEQ ID NO: 667 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 668 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 669 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagcgttcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 670 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKRSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSDSTGKKSLRFPRFVRFRPDKE

SEQ ID NO: 671 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 672 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSDSTGKKSLRFPRFVRFRPDKE

SEQ ID NO: 673 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 674 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 675 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctgtcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 676 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSVGGGYTDEMRVDLWARRNELINKVIEIEYREESTSSSTGKKSLRFPRFVRFRPDKE

SEQ ID NO: 677 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 678 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 679 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 680 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 681 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 682 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSLSTGKKSLRFPRFVRFRPDKE

SEQ ID NO: 683 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagcgttcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctgtcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 684 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKRSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSVGGGYTDEMRVDLWARRNELINKVIEIEYREESTSSSTGKKSLRFPRFVRFRPDKE

SEQ ID NO: 685 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctgtcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 686 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSVGGGYTDEMRVDLWARRNELINKVIEIEYREESTSSSTGKKSLRFPRFVRFRPDKE

SEQ ID NO: 687 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 688 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKRSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 689 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcagatagcaccggtaagaaatctttacgtttcccgcgttttgttcgctttcgtccggacaaagag

SEQ ID NO: 690 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSDSTGKKSLRFPRFVRFRPDKE

SEQ ID NO: 691 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagtagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 692 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGVVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 693 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 694 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSLSTGKKSLRFPRFVRFRPDKE

SEQ ID NO: 695 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagtagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 696 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGVVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 697 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 698 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKRSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 699 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 700 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 701 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 702 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKRSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 703 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 704 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKRSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 705 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgtgcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 706 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSLSTGKKSLRFPRFVRFRPDKE

SEQ ID NO: 707 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 708 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 709 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagcagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 710 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 711 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 712 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 713 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggatgtgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 714 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGCVVLKSRNGKIITGYTGIEQDIAQLPVGFMYDGEIMAPSGKFADVQKSAFKRSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 715 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggagaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaagtggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgccctggtcgtcgagtataaaggcaacgaagtttctatcggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 716 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGEVVLKSRNGKIITGYTGIEQDIAQLPVGFMYDGEIMAPSGKFADVQKSAFKKSDDKVGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 717 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagcgttcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcactgagcaccggtaagaaatctttacgtttcccgcgttttgttcgctttcgtccggacaaagag

SEQ ID NO: 718 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKRSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSLSTGKKSLRFPRFVRFRPDKE

SEQ ID NO: 719 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgcctggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 720 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREESTSSSTGKKSLRFPRFVRFRPDKE

SEQ ID NO: 721 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 722 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 723 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaacgacatcatcgagcaccggtaagaaatctttacgtttcccgcgttttgttcgctttcgtccggacaaagag

SEQ ID NO: 724 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREETTSSSTGKKSLRFPRFVRFRPDKE

SEQ ID NO: 725 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 726 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 727 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatggccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 728 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKWPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 729 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatggccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaagtcacatcatcgagcaccggtaagaaatctttacgtttcccgcgttttgttcgctttcgtccggacaaagag

SEQ ID NO: 730 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKWPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEVTSSSTGKKSLRFPRFVRFRPDKE

SEQ ID NO: 731 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggaggatcgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaacgacatcatcgagcaccggtaagaaatctttacgtttcccgcgttttgttcgctttcgtccggacaaagag

SEQ ID NO: 732 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEDRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREETTSSSTGKKSLRFPRFVRFRPDKE

SEQ ID NO: 733 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaagtcacatcatcgagcaccggtaagaaatctttacgtttcccgcgttttgttcgctttcgtccggacaaagag

SEQ ID NO: 734 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEVTSSSTGKKSLRFPRFVRFRPDKE

SEQ ID NO: 735 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggaggatcgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 736 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEDRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 737 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaagcgacatcatcgagcaccggtaagaaatctttacgtttcccgcgttttgttcgcttccgtccggacaaagag

SEQ ID NO: 738 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEATSSSTGKKSLRFPRFVRFRPDKE

SEQ ID NO: 739 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatggccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaactgacatcatcgagcaccggtaagaaatctttacgtttcccgcgttttgttcgctttcgtccggacaaagag

SEQ ID NO: 740 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKWPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREELTSSSTGKKSLRFPRFVRFRPDKE

SEQ ID NO: 741 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgtcggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcacttgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaacgacatcatcgagcaccggtaagaaatctttacgtttcccgcgttttgttcgctttcgtccggacaaagag

SEQ ID NO: 742 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAASDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREETTSSSTGKKSLRFPRFVRFRPDKE

SEQ ID NO: 743 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatggccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaagtttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaacgacatcatcgagcaccggtaagaaatctttacgtttcccgcgttttgttcgctttcgtccggacaaagag

SEQ ID NO: 744 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKWPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREETTSSSTGKKSLRFPRFVRFRPDKE

SEQ ID NO: 745 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaacggtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatggccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 746 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNGELTGNAALDSLAVFLSDCGQKEAEWYMKSIQKDFKIGITAKSINKVIPCLIAEYSCALAKPLKKWPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 747 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgtcggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatggccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggaggatcgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaagtcacatcatcgagcaccggtaagaaatctttacgtttcccgcgttttgttcgctttcgtccggacaaagag

SEQ ID NO: 748 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAASDSLAVFLSDCGQKEAEWYMKSIQKDFKIGITAKSINKVIPCLIAEYSCALAKPLKKWPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEDRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEVTSSSTGKKSLRFPRFVRFRPDKE

SEQ ID NO: 749 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgttgaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 750 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFVEGKEGTKNEGVLGALVVEYKGNEVSIGGGYTDEMRVDLWARRNELINKVIEIEYREESTSSSTGKKSLRFPRFVRFRPDKE

SEQ ID NO: 751 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttagcggaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 752 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLAEVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 753 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaaccgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 754 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEPGKEGTKNEGVLGALVVEYKGNEVSIGGGYTDEMRVDLWARRNELINKVIEIEYREESTSSSTGKKSLRFPRFVRFRPDKE

SEQ ID NO: 755 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccgggcagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 756 - protein, 437 aa, synthetic construct
  REGION 1..437: note = Engineered DNA ligase variant
MHHHHHHGGSGMTGQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 757 - DNA, 1311 bp, synthetic construct
  misc_feature 1..1311: note = Engineered DNA ligase variant
  source 1..1311: mol_type = other DNA
atgcaccatcatcatcatcatggcggtagcggcatgacctctcagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 758 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 759 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttggtgtcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 760 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWCRRNELINKVIEIEYREESTSSSTGKKSLRFPRFVRFRPDKE

SEQ ID NO: 761 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagataggaaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 762 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDRKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 763 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtaaggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 764 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRKDLWARRNELINKVIEIEYREESTSSSTGKKSLRFPRFVRFRPDKE

SEQ ID NO: 765 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttatcggaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 766 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLSEVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 767 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggtgtctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 768 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALVSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 769 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtcgcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 770 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVSHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 771 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgcttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 772 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVLHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 773 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcagattgtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 774 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQIVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 775 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacgcgcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 776 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYARELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 777 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctaagcgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 778 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWAKRNELINKVIEIEYREESTSSSTGKKSLRFPRFVRFRPDKE

SEQ ID NO: 779 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccagattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 780 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTQILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 781 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaaactctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 782 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQTLPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 783 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaggtcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 784 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITARSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 785 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaaagtggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 786 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFESGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 787 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccctgtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 788 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 789 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccacgcagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 790 - protein, 437 aa, synthetic construct
  REGION 1..437: note = Engineered DNA ligase variant
MHHHHHHGGSGMTTQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 791 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctgagttgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 792 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLSWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 793 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgggaaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 794 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDGKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 795 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctgtcttctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 796 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALSSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 797 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggcagtaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 798 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGSKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 799 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatctggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 800 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFESGKEGTKNEGVLGALVVEYKGNEVSIGGGYTDEMRVDLWARRNELINKVIEIEYREESTSSSTGKKSLRFPRFVRFRPDKE

SEQ ID NO: 801 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacggtcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 802 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYGRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 803 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgacggactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 804 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLTDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 805 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcgggtcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 806 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIGSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 807 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagtgctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 808 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQVLPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 809 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggcgttaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 810 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGVKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 811 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaaatgctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 812 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQMLPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 813 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagttggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 814 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEVGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 815 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttggtctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 816 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFGLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 817 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcagaaggtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 818 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQKVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 819 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgaagcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 820 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVKHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 821 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaacggggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 822 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFERGKEGTKNEGVLGALVVEYKGNEVSIGGGYTDEMRVDLWARRNELINKVIEIEYREESTSSSTGKKSLRFPRFVRFRPDKE

SEQ ID NO: 823 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgccctcgggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 824 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPSGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 825 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttaatgcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 826 - protein, 437 aa, synthetic construct
  REGION 1..437: note = Engineered DNA ligase variant
MHHHHHHGGSGMTKQIVNAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 827 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctggcggactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 828 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLADCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 829 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcagtctgtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 830 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQSVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 831 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgccctttggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 832 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPFGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 833 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattaatggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 834 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIINGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 835 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcaaggtttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 836 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLARFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 837 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagataagaaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 838 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDKKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 839 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattcttggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 840 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIILGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 841 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaggtcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 842 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIRSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 843 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagtgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 844 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEVGKEGTKNEGVLGALVVEYKGNEVSIGGGYTDEMRVDLWARRNELINKVIEIEYREESTSSSTGKKSLRFPRFVRFRPDKE

SEQ ID NO: 845 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattcggggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 846 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIIRGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 847 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatgcgttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 848 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINALREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 849 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaatatctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 850 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQYLPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 851 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgggggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 852 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPGGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 853 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattggttaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 854 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLVNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 855 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaaagtttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 856 - protein, 437 aa, synthetic construct
  REGION 1..437: note = Engineered DNA ligase variant
MHHHHHHGGSGMTKQIVQAFELLEAIGGTTSRTAKESFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 857 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaaggtgaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 858 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKVKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 859 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatagtaaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 860 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDSKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 861 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggctataaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 862 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGYKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 863 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttactcgggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 864 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYSGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 865 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaataatttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 866 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINNLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 867 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatcagaaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 868 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDQKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 869 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctgctttgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 870 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLLWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 871 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgccctggggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 872 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPWGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 873 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattatttggggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 874 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIIWGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 875 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaacatggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 876 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEHGKEGTKNEGVLGALVVEYKGNEVSIGGGYTDEMRVDLWARRNELINKVIEIEYREESTSSSTGKKSLRFPRFVRFRPDKE

SEQ ID NO: 877 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatctttcagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 878 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIFQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 879 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaattgctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 880 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQLLPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 881 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggttgtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 882 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQVVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 883 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctggatctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 884 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELDLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 885 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacactcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 886 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYTRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 887 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctgactcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 888 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILTQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 889 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcagttataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 890 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVSYKGNEVSIGGGYTDEMRVDLWARRNELINKVIEIEYREESTSSSTGKKSLRFPRFVRFRPDKE

SEQ ID NO: 891 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgcggaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 892 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLRNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 893 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttaggctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 894 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFRLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 895 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgtggccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 896 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSWPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 897 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctatgcgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 898 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWAMRNELINKVIEIEYREESTSSSTGKKSLRFPRFVRFRPDKE

SEQ ID NO: 899 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggcgtgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 900 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLAWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 901 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgataaggtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 902 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDKVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 903 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctgctgtctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 904 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALLSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 905 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattggcgaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 906 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLANRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 907 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgcttataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 908 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVAYKGNEVSIGGGYTDEMRVDLWARRNELINKVIEIEYREESTSSSTGKKSLRFPRFVRFRPDKE

SEQ ID NO: 909 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatgttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 910 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYVDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 911 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacgttcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 912 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYVRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 913 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaattctttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 914 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINSLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 915 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaatctaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 916 - protein, 437 aa, synthetic construct
  REGION 1..437: note = Engineered DNA ligase variant
MHHHHHHGGSGMTKQIVQAFELLEAIGGTTSRTAKEDFLRAGESNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 917 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatccatcagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 918 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIHQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 919 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgaccggtattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 920 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTGILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 921 - DNA, 1311 bp, synthetic construct
  misc_feature 1..1311: note = Engineered DNA ligase variant
  source 1..1311: mol_type = other DNA
atgcaccatcatcatcatcatggcggtagcggcgcgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 922 - protein, 437 aa, synthetic construct
  REGION 1..437: note = Engineered DNA ligase variant
MHHHHHHGGSGATKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 923 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacctgggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 924 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYLGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 925 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattgcgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 926 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIIAGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 927 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattaagggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 928 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIIKGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 929 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagggctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 930 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQGLPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 931 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 932 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEERVDLWARRNELINKVIEIEYREESTSSSTGKKSLRFPRFVRFRPDKE

SEQ ID NO: 933 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcgctctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 934 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRALEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 935 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcggttccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatacccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaagtggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaaagcacatcatcgagcaccggtaagaaatctttacgtttcccgcgttttgttcgctttcgtccggacaaagag

SEQ ID NO: 936 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSVPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKVGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREESTSSSTGKKSLRFPRFVRFRPDKE

SEQ ID NO: 937 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 938 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 939 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagaaattctcattcgcacctataatccggatctgatctaccgtgtgaaaaagaagatcaagatcaaatcgttaccaaccgactatggtaacctgcaggataattacatttcctatcttgatctgacgagtaaattgtacacccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgtctggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 940 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYTRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREEQTSSSTGKKSLRFPRFVRFRPDKE

SEQ ID NO: 941 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagaaattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcgctggtcgtcgagtataaaggcaacgaagtttctattggcggcggatatacggacaaaatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 942 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDKMRVDLWARRNELINKVIEIEYREEQTSSSTGKKSLRFPRFVRFRPDKE

SEQ ID NO: 943 - DNA, 1311 bp, synthetic construct
  misc_feature 1..1311: note = Engineered DNA ligase variant
  source 1..1311: mol_type = other DNA
atgcaccatcatcatcatcatggcggtagcggcatgcgcaaacagattgttcaagcgtttgaactgctggaggcaatcggcggcactactagccgtacggccaaggaagatttcttgcgcgctggtgaagacaacgggatcttcaaagaaattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtacccgtaatgaaggcgttctgggtgcgctggtcgtcgagtataaaggcaacgaagtttctattggcggcggatatacggacaaaatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 944 - protein, 437 aa, synthetic construct
  REGION 1..437: note = Engineered DNA ligase variant
MHHHHHHGGSGMRKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTRNEGVLGALVVEYKGNEVSIGGGYTDKMRVDLWARRNELINKVIEIEYREEQTSSSTGKKSLRFPRFVRFRPDKE

SEQ ID NO: 945 - DNA, 1311 bp, synthetic construct
  misc_feature 1..1311: note = Engineered DNA ligase variant
  source 1..1311: mol_type = other DNA
atgcaccatcatcatcatcatggcggtagcggcatgcgcaaacagattgttcaagcgtttgaactgctggaggcaatcggcggcactactagccgtacggccaaggaagatttcttgcgcgctggtgaagacaacgggatcttcaaagaaattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggacacgtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcgctggtcgtcgagtataaaggcaacgaagtttctattggcggcggatatacggacaaaatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 946 - protein, 437 aa, synthetic construct
  REGION 1..437: note = Engineered DNA ligase variant
MHHHHHHGGSGMRKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGHVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDKMRVDLWARRNELINKVIEIEYREEQTSSSTGKKSLRFPRFVRFRPDKE

SEQ ID NO: 947 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaaactattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaagtcagatgataaacaggggattctgcatatctttgatgctgttccaatccacgagtttgaagcgggagaatcgacccgcattctggagtaccgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtacccgtaatgaaggcgttctgggttgtctggtcgtcgagtataaaggcaacgaagtttctattggcggcggatatacggacaaaatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 948 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKTILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEYRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTRNEGVLGCLVVEYKGNEVSIGGGYTDKMRVDLWARRNELINKVIEIEYREEQTSSSTGKKSLRFPRFVRFRPDKE

SEQ ID NO: 949 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagaaattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtacccgtaatgaaggcgttctgggttgtctggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 950 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTRNEGVLGCLVVEYKGNEVSIGGGYTDEMRVDLWARRNELINKVIEIEYREEQTSSSTGKKSLRFPRFVRFRPDKE

SEQ ID NO: 951 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagaaattctcattcgcacctataatccggatctgatctacggtgtgaaaaagaagatcaagatcaaatcgttaccaaccgactatggtaacctgcaggataattacatttcctatcttgatctgacgagtaaattgtacacccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggttgtctggtcgtcgagtataaaggcaacgaagtttctattggcggcggatatacggacgaaatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 952 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYTRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGCLVVEYKGNEVSIGGGYTDEMRVDLWARRNELINKVIEIEYREEQTSSSTGKKSLRFPRFVRFRPDKE

SEQ ID NO: 953 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagaaattctcattcgcacctataatccggatctgacctaccgtgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaggtggtgttgaagagtcgcaatggtaagattattacgggttacaccggcatcgaacaagatatcgcccagttgccctggggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcgctggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 954 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPWGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 955 - DNA, 1311 bp, synthetic construct
  misc_feature 1..1311: note = Engineered DNA ligase variant
  source 1..1311: mol_type = other DNA
atgcaccatcatcatcatcatggcggtagcgatatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagaaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 956 - protein, 437 aa, synthetic construct
  REGION 1..437: note = Engineered DNA ligase variant
MHHHHHHGGSDMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQKEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 957 - DNA, 1311 bp, synthetic construct
  misc_feature 1..1311: note = Engineered DNA ligase variant
  source 1..1311: mol_type = other DNA
atgcaccatcatcatcatcatggcggtagcgatatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 958 - protein, 437 aa, synthetic construct
  REGION 1..437: note = Engineered DNA ligase variant
MHHHHHHGGSDMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 959 - DNA, 1311 bp, synthetic construct; identical to SEQ ID NO: 61
  misc_feature 1..1311: note = Engineered DNA ligase variant
  source 1..1311: mol_type = other DNA

SEQ ID NO: 960 - protein, 437 aa, synthetic construct; identical to SEQ ID NO: 62
  REGION 1..437: note = Engineered DNA ligase variant

SEQ ID NO: 961 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgtctattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 962 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTSIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 963 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcttgcgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 964 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCLRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 965 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgactatcaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 966 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDYQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 967 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgtggaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 968 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFVEGKEGTKNEGVLGALVVEYKGNEVSIGGGYTDEMRVDLWARRNELINKVIEIEYREEQTSSSTGKKSLRFPRFVRFRPDKE

SEQ ID NO: 969 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcgttggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 970 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGVGYTDEMRVDLWARRNELINKVIEIEYREEQTSSSTGKKSLRFPRFVRFRPDKE

SEQ ID NO: 971 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagtgtgaataccgtgaagaacagacatcatcgagcaccggtaagaaatctttacgtttcccgcgttttgttcgctttcgtccggacaaagag

SEQ ID NO: 972 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIECEYREEQTSSSTGKKSLRFPRFVRFRPDKE

SEQ ID NO: 973 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaggatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 974 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKRIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 975 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtcgtgatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 976 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRRDLWARRNELINKVIEIEYREEQTSSSTGKKSLRFPRFVRFRPDKE

SEQ ID NO: 977 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcgaagctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 978 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAKLDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 979 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctcggaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 980 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGSEEGKEGTKNEGVLGALVVEYKGNEVSIGGGYTDEMRVDLWARRNELINKVIEIEYREEQTSSSTGKKSLRFPRFVRFRPDKE

SEQ ID NO: 981 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctcagaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 982 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPQKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 983 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcacgggctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 984 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCARAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 985 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcctgctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 986 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGLLGALVVEYKGNEVSIGGGYTDEMRVDLWARRNELINKVIEIEYREEQTSSSTGKKSLRFPRFVRFRPDKE

SEQ ID NO: 987 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactcgtcgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 988 - protein, 437 aa, synthetic construct
  REGION 1..437: note = Engineered DNA ligase variant
MHHHHHHGGSGMTKQIVQAFELLEAIGGTTRRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 989 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcctaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 990 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVPKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 991 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaagtatgatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 992 - protein, 437 aa, synthetic construct
  REGION 1..437: note = Engineered DNA ligase variant
MHHHHHHGGSGMTKQIVQAFELLEAIGGTTSRTAKYDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 993 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcgacttattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 994 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIATYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 995 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagttgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 996 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSVDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 997 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgtggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 998 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNVALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 999 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgcggaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1000 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFAEGKEGTKNEGVLGALVVEYKGNEVSIGGGYTDEMRVDLWARRNELINKVIEIEYREEQTSSSTGKKSLRFPRFVRFRPDKE

SEQ ID NO: 1001 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctactttgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1002 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYFVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1003 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgacgagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1004 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMTSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1005 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggctgtctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1006 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGCLGALVVEYKGNEVSIGGGYTDEMRVDLWARRNELINKVIEIEYREEQTSSSTGKKSLRFPRFVRFRPDKE

SEQ ID NO: 1007 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttattgacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1008 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFIDVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1009 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaaagtttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1010 - protein, 437 aa, synthetic construct
  REGION 1..437: note = Engineered DNA ligase variant
MHHHHHHGGSGMTKQIVQAFELLEAIGGTTSRTAKESFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1011 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaaggtttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1012 - protein, 437 aa, synthetic construct
  REGION 1..437: note = Engineered DNA ligase variant
MHHHHHHGGSGMTKQIVQAFELLEAIGGTTSRTAKEGFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1013 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcaatggataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1014 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSMDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1015 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcatgggataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1016 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSWDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1017 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcacaggataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1018 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSQDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1019 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgtgtaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1020 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVCKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1021 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcaagtgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1022 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSSDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1023 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcaacggataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1024 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSTDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1025 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgcggtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1026 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRGNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1027 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcacctgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1028 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSPDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1029 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaaaatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1030 - protein, 437 aa, synthetic construct
  REGION 1..437: note = Engineered DNA ligase variant
MHHHHHHGGSGMTKQIVQAFELLEAIGGTTSRTAKENFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1031 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaattctttacgtttcccgcgttttgttcgctttcgtccggacaaagag

SEQ ID NO: 1032 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKNSLRFPRFVRFRPDKE

SEQ ID NO: 1033 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaattttcggacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1034 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFSDVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1035 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgcggagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1036 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMRSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1037 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcatttgtaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1038 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSICKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1039 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgactaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1040 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVTKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1041 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggcttttgggaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1042 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFWEGKEGTKNEGVLGALVVEYKGNEVSIGGGYTDEMRVDLWARRNELINKVIEIEYREEQTSSSTGKKSLRFPRFVRFRPDKE

SEQ ID NO: 1043 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaagtgatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1044 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEVMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1045 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgaggttgaataccgtgaagaacagacatcatcgagcaccggtaagaaatctttacgtttcccgcgttttgttcgctttcgtccggacaaagag

SEQ ID NO: 1046 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEVEYREEQTSSSTGKKSLRFPRFVRFRPDKE

SEQ ID NO: 1047 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgttctgatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1048 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRSDLWARRNELINKVIEIEYREEQTSSSTGKKSLRFPRFVRFRPDKE

SEQ ID NO: 1049 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaaacttttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1050 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKTFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1051 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttatggacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1052 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFMDVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1053 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcaccccgaatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1054 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTPNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1055 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgaggacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1056 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFEDVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1057 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgcgtagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1058 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLRSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1059 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtattgatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1060 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRIDLWARRNELINKVIEIEYREEQTSSSTGKKSLRFPRFVRFRPDKE

SEQ ID NO: 1061 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactctgtaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1062 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALCKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1063 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagcgtagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1064 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQRSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1065 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcgttttattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1066 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAFYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1067 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcgtgttattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1068 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIACYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1069 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcaaatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1070 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSNDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1071 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtttggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1072 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRLDLWARRNELINKVIEIEYREEQTSSSTGKKSLRFPRFVRFRPDKE

SEQ ID NO: 1073 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaaacgttacgtttcccgcgttttgttcgctttcgtccggacaaagag

SEQ ID NO: 1074 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKTLRFPRFVRFRPDKE

SEQ ID NO: 1075 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacgcttaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1076 - protein, 437 aa, synthetic construct
  REGION 1..437: note = Engineered DNA ligase variant
MHHHHHHGGSGMTKQIVQAFELLEAIGGTTSRTLKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1077 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaaattaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1078 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNREITGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1079 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggctgtggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1080 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGCGYTDEMRVDLWARRNELINKVIEIEYREEQTSSSTGKKSLRFPRFVRFRPDKE

SEQ ID NO: 1081 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggagctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1082 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPELIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1083 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgccgtcgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1084 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCRRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1085 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggattatatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1086 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDYIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1087 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaaggtaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1088 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNREGTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1089 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacgcgtaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1090 - protein, 437 aa, synthetic construct
  REGION 1..437: note = Engineered DNA ligase variant
MHHHHHHGGSGMTKQIVQAFELLEAIGGTTSRTRKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1091 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaacttttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1092 - protein, 437 aa, synthetic construct
  REGION 1..437: note = Engineered DNA ligase variant
MHHHHHHGGSGMTKQIVQAFELLEAIGGTTSRTAKELFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1093 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgttgtgatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1094 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRCDLWARRNELINKVIEIEYREEQTSSSTGKKSLRFPRFVRFRPDKE

SEQ ID NO: 1095 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtcggaaatctttacgtttcccgcgttttgttcgctttcgtccggacaaagag

SEQ ID NO: 1096 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGRKSLRFPRFVRFRPDKE

SEQ ID NO: 1097 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctacggcgtgaaaaagaagatcaagatcaaatcgttaccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtcgtattattacgggttacaccggcatcgaacaagatatcgcccagttgcccgtcggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1098 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYGVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGRIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1099 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttaccgtgtgaaaaagaagatcaagatcaaatcgctgccgaccgattatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacactggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggagtgggtccagcctgatggcgtgttcgaagatagcgaggagagtcagcaggaagtgctgcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1100 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVLHLHRHNRAQGYEGTMIKDLDATYKCKRSFDIQKIVDVNRVDLTVVGFESGKEGTKNEGVLGALVVEYKGNEVSIGGGYTDEERVDLWARRNELINKVIEIEYREEQTSSSTGKKSLRFPRFVRFRPDKE

SEQ ID NO: 1101 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaagcagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgtcgaccctgtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacagtggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggagtgggtccagcctgatggcgtgttcgaagatagcgaggagagtcagcaggaagtgctgcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaaccgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1102 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLSTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYSGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVLHLHRHNRAQGYEGTMIKDLDATYKCKRSFDIQKIVDVNRVDLTVVGFEPGKEGTKNEGVLGALVVEYKGNEVSIGGGYTDEMRVDLWARRNELINKVIEIEYREEQTSSSTGKKSLRFPRFVRFRPDKE

SEQ ID NO: 1103 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaagcagattgttcaagcgtttgaactgctggaggcaatcggcggcactactagccgtacggccaaggaagatttcttgcgcgctggtgaagacaacgggatcttcaaagagattctcattcgcacctataatccggatctgacttaccgtgtgaaaaagaagatcaagatcaaatcgctgtcgaccctgtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggagcagtggtgttgaagagtcgcaatggtaagattattacgggttacagtggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgctgcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaaccgggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1104 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYRVKKKIKIKSLSTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGAVVLKSRNGKIITGYSGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVLRLHRHNRAQGYEGTMIKDLDATYKCKRSFDIQKIVDVNRVDLTVVGFEPGKEGTKNEGVLGALVVEYKGNEVSIGGGYTDEERVDLWARRNELINKVIEIEYREEQTSSSTGKKSLRFPRFVRFRPDKE

SEQ ID NO: 1105 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccggccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaatcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacagtggcatcgaacaagatatcgcccagttgcccgtgggctttatgtatgacggtgaaattatggcgccgtccggcaaatttgcagacgttcagaaaagtgccttcaagaaatcagatcgtaaacaggggattctgcatatctttgatgctgttccaatccacgagtttgaagcgggagaatcgacccgcattctggagcaacgtattaatttcttacgcgaagtagacgaacagtacattcaagagctgccgctttcgaacctgagttgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaaccgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1106 - protein, 437 aa, synthetic construct
  REGION 1..437: note = Engineered DNA ligase variant
MHHHHHHGGSGMTGQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYSGIEQDIAQLPVGFMYDGEIMAPSGKFADVQKSAFKKSDRKQGILHIFDAVPIHEFEAGESTRILEQRINFLREVDEQYIQELPLSNLSWVQPDGVFEDSEESQQEVFHLHRHNRAQGYEGTMIKDLDATYKCKRSFDIQKIVDVNRVDLTVVGFEPGKEGTKNEGVLGALVVEYKGNEVSIGGGYTDEMRVDLWARRNELINKVIEIEYREEQTSSSTGKKSLRFPRFVRFRPDKE

SEQ ID NO: 1107 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccaaaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgagccatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagatctcatcgagcaccggtaagaaatctttacgtttcccgcgttttgttcgctttcgtccggacaaagag

SEQ ID NO: 1108 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVSHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQISSSTGKKSLRFPRFVRFRPDKE

SEQ ID NO: 1109 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccgaccctgtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgtattctggagcaacgtattaatttcttacgcgaagtagacgaacagtacattcaagagctgccgctttcgaacctggaatgggtccagcctgatggcgtgttcgaagatagcgaggagagtcagcaggaagtgtttcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgagatgcgtgtggatctttggtgccgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1110 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFESGKEGTKNEGVLGALVVEYKGNEVSIGGGYTDEMRVDLWCRRNELINKVIEIEYREEQTSSSTGKKSLRFPRFVRFRPDKE

SEQ ID NO: 1111 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgaccctgattctggagcaacgtattaatttcttacgcgaagtagacgaacagtacattcaagagctgccgctttcgaacctggaatgggtccagcctgatggcgtgttcgaagatagcgaggagagtcagcaggaagtgctgcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttggtgccgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1112 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTLILEQRINFLREVDEQYIQELPLSNLEWVQPDGVFEDSEESQQEVLHLHRHNRAQGYEGTMIKDLDATYKCKRSFDIQKIVDVNRVDLTVVGFEEGKEGTKNEGVLGALVVEYKGNEVSIGGGYTDEMRVDLWCRRNELINKVIEIEYREEQTSSSTGKKSLRFPRFVRFRPDKE

SEQ ID NO: 1113 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttaccgtgtgaaaaagaagatcaagatcaaatcgctgccgaccctgtatggtaacctgcaggataattacatttcctatcttgatctgacgagtaaattgtacgcccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatcgtaaacaggggattctgcatatctttgatgctgttccaatccacgagtttgaagcgggagaatcgacccgtattctggagcaacgtattaatttcttacgcgaagtagacgaacagtacattcaagagctgccgctttcgaacctggaatgggtccagcctgatggcgtgttcgaagatagcgaggagagtcagcaggaagtgctgcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggagggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1114 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYRVKKKIKIKSLPTLYGNLQDNYISYLDLTSKLYARELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDRKQGILHIFDAVPIHEFEAGESTRILEQRINFLREVDEQYIQELPLSNLEWVQPDGVFEDSEESQQEVLRLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1115 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccaaaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcagattgtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagatctcatcgagcaccggtaagaaatctttacgtttcccgcgttttgttcgctttcgtccggacaaagag

SEQ ID NO: 1116 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQIVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQISSSTGKKSLRFPRFVRFRPDKE

SEQ ID NO: 1117 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgtggccaaccgattatggtaacctgcaggataattacatttcctatcttgatctgacgagtaaattgtacaaccgtgaactgaccggtaatgcggcgctgtcgtctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagtgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagatctcatcgagcaccggtaagaaatctttacgtttcccgcgttttgttcgctttcgtccggacaaagag

SEQ ID NO: 1118 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSWPTDYGNLQDNYISYLDLTSKLYNRELTGNAALSSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQISSSTGKKSLRFPRFVRFRPDKE

SEQ ID NO: 1119 - DNA, 1311 bp, synthetic construct
  misc_feature 1..1311: note = Engineered DNA ligase variant
  source 1..1311: mol_type = other DNA
atgcaccatcatcatcatcatggcggtagcggcgctaccggccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaatcgggagaatcgacccagattctggagcaacgtattaatttcttacgcgaagtagacgaacagtacattcaagagctgccgctttcgaacctgagttgggtccagcctgatggcgtgttcgaagatagcgaggagagtcagcaggaagtgctgcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggagggtaccaagaatgaaggcgttctgggtgcactggtcgtcgagtataaaggcaacgaagtttctattggcggcggatatacggacgagatgcgtgtggatctttggtgccgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1120 - protein, 437 aa, synthetic construct
  REGION 1..437: note = Engineered DNA ligase variant
MHHHHHHGGSGATGQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFESGESTQILEQRINFLREVDEQYIQELPLSNLSWVQPDGVFEDSEESQQEVLRLHRHNRAQGYEGTMIKDLDATYKCKRSFDIQKIVDVNRVDLTVVGFEEGKEGTKNEGVLGALVVEYKGNEVSIGGGYTDEMRVDLWCRRNELINKVIEIEYREEQTSSSTGKKSLRFPRFVRFRPDKE

SEQ ID NO: 1121 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaagcagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgtcgaccctgtatggtaacctgcaggataattacatttcctatcttgatctgacgagtaaattgtacaaccgtgaactgaccggtaatgcggcgctggattctttagcagtctttctgtcagactgcggcgtcaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacactggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgtattctggagcaacgtattaatttcttacgcgaagtagacgaacagtacattcaagagctgccgctttcgaacctggaatgggtccagcctgatggcgtgttcgaagatagcgaggagagtcagcaggaagtgtttcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1122 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLSTLYGNLQDNYISYLDLTSKLYNRELTGNAALDSLAVFLSDCGVKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFRLHRHNRAQGYEGTMIKDLDATYKCKRSFDIQKIVDVNRVDLTVVGFESGKEGTKNEGVLGALVVEYKGNEVSIGGGYTDEMRVDLWARRNELINKVIEIEYREEQTSSSTGKKSLRFPRFVRFRPDKE

SEQ ID NO: 1123 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccacgcagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccgaccgattatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaatcgggagaatcgacccagattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggagggtaccaagaatgaaggcgttctgggtgcactggtcgtcgagtataaaggcaacgaagtttctattggcggcggatatacggacgagatgcgtgtggatctttggtgccgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1124 - protein, 437 aa, synthetic construct
  REGION 1..437: note = Engineered DNA ligase variant
MHHHHHHGGSGMTTQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFESGESTQILEQRINFLREVDEQYIQELPLSNLEWVQPDGVFEDSEESQQEVFHLHRHNRAQGYEGTMIKDLDATYKCKRSFDIQKIVDVNRVDLTVVGFESGKEGTKNEGVLGALVVEYKGNEVSIGGGYTDEMRVDLWCRRNELINKVIEIEYREEQTSSSTGKKSLRFPRFVRFRPDKE

SEQ ID NO: 1125 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgattatggtaacctgcaggataattacatttcctatcttgatctgacgagtaaattgtacggtcgtgaactgaccggtaatgcggcgctgtcgtctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagtgaggagagtcagcagattgtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgtcgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1126 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYGRELTGNAALSSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQIVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1127 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctgtcgtctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacctcatcgagcaccggtaagaaatctttacgtttcccgcgttttgttcgctttcgtccggacaaagag

SEQ ID NO: 1128 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYNRELTGNAALSSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1129 - DNA, 1311 bp, synthetic construct
  misc_feature 1..1311: note = Engineered DNA ligase variant
  source 1..1311: mol_type = other DNA
atgcaccatcatcatcatcatggcggtagcggcgctaccggccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggagtgggtccagcctgatggcgtgttcgaagatagcgaggagagtcagcaggaagtgctgcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1130 - protein, 437 aa, synthetic construct
  REGION 1..437: note = Engineered DNA ligase variant
MHHHHHHGGSGATGQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVLRLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1131 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccggccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaatcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggagtgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1132 - protein, 437 aa, synthetic construct
  REGION 1..437: note = Engineered DNA ligase variant
MHHHHHHGGSGMTGQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFESGKEGTKNEGVLGALVVEYKGNEVSIGGGYTDEERVDLWARRNELINKVIEIEYREEQTSSSTGKKSLRFPRFVRFRPDKE

SEQ ID NO: 1133 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccggccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaatcgtgaactgaccggtaatgcggcgctggattctttagcagtctttctgtcagactgcggcgtcaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaatcgggagaatcgacccgtattctggagcaacgtattaatttcttacgcgaagtagacgaacagtacattcaagagctgccgctttcgaacctggaatgggtccagcctgatggcgtgttcgaagatagcgaggagagtcagcaggaagtgtttcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1134 - protein, 437 aa, synthetic construct
  REGION 1..437: note = Engineered DNA ligase variant
MHHHHHHGGSGMTGQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGVKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFESGESTRILEQRINFLREVDEQYIQELPLSNLEWVQPDGVFEDSEESQQEVFRLHRHNRAQGYEGTMIKDLDATYKCKRSFDIQKIVDVNRVDLTVVGFESGKEGTKNEGVLGALVVEYKGNEVSIGGGYTDEMRVDLWARRNELINKVIEIEYREEQTSSSTGKKSLRFPRFVRFRPDKE

SEQ ID NO: 1135 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgtattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1136 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEERVDLWARRNELINKVIEIEYREEQTSSSTGKKSLRFPRFVRFRPDKE

SEQ ID NO: 1137 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacactggcatcgaacaagatatcgcccagttgcccgtgggctttatgtatgacggtgaaattatggcgccgtccggcaaatttgcagacgttcagaaaagtgccttcaagaaatcagatcgtaaacaggggattctgcatatctttgatgctgttccaatccacgagtttgaagcgggagaatcgacccgcattctggagcaacgtattaatttcttaagcgaagtagacgaacagtacattcaagagctgccgctttcgaacctggaatgggtccagcctgatggcgtgttcgaagatagcgaggagagtcagcaggaagtgtttcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaaccgggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1138 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDRKQGILHIFDAVPIHEFEAGESTRILEQRINFLSEVDEQYIQELPLSNLEWVQPDGVFEDSEESQQEVFHLHRHNRAQGYEGTMIKDLDATYKCKRSFDIQKIVDVNRVDLTVVGFEPGKEGTKNEGVLGALVVEYKGNEVSIGGGYTDEERVDLWARRNELINKVIEIEYREEQTSSSTGKKSLRFPRFVRFRPDKE

SEQ ID NO: 1139 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgacttaccgtgtgaaaaagaagatcaagatcaaatcgctgccgaccctgtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggagtagtggtgttgaagagtcgcaatggtaagattattacgggttacagtggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgctgcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggagggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1140 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLTYRVKKKIKIKSLPTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGVVVLKSRNGKIITGYSGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVLRLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1141 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccggccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttggtgccgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1142 - protein, 437 aa, synthetic construct
  REGION 1..437: note = Engineered DNA ligase variant
MHHHHHHGGSGMTGQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWCRRNELINKVIEIEYREEQTSSSTGKKSLRFPRFVRFRPDKE

SEQ ID NO: 1143 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatttaccgtgtgaaaaagaagatcaagatcaaatcgctgccgaccgattatggtaacctgcaggataattacatttcctatcttgatctgacgagtaaattgtacaatcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagagggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1144 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFRLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1145 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccaaaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacctcatcgagcaccggtaagaaatctttacgtttcccgcgttttgttcgctttcgtccggacaaagag

SEQ ID NO: 1146 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1147 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggtttctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcagattgtgagccatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgtcgcaatgaactgatcaacaaagtgattgagattgaataccgtgaagaacagacctcatcgagcaccggtaagaaatctttacgtttcccgcgttttgttcgctttcgtccggacaaagag

SEQ ID NO: 1148 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALVSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQIVSHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1149 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgattatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatagcaaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcagattgtgagccatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1150 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDSKQGILHIFDAVPIHEFEAGESTRILEQRINFLREVDEQYIQELPLSNLEWVQPDGVFEDSEESQQIVSHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1151 - DNA, 1311 bp, synthetic construct
  misc_feature 1..1311: note = Engineered DNA ligase variant
  source 1..1311: mol_type = other DNA
atgcaccatcatcatcatcatggcggtagcggcattaccggtcagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggagtagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1152 - protein, 437 aa, synthetic construct
  REGION 1..437: note = Engineered DNA ligase variant
MHHHHHHGGSGITGQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGVVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFESGKEGTKNEGVLGALVVEYKGNEVSIGGGYTDEMRVDLWARRNELINKVIEIEYREEQTSSSTGKKSLRFPRFVRFRPDKE

SEQ ID NO: 1153 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgtattctggagcaacgtattaatttcttacgcgaagtagacgaacagtacattcaagagctgccgctttcgaacctggaatgggtccagcctgatggcgtgttcgaagatagcgaggagagtcagcaggaagtgtttcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1154 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFRLHRHNRAQGYEGTMIKDLDATYKCKRSFDIQKIVDVNRVDLTVVGFEEGKEGTKNEGVLGALVVEYKGNEVSIGGGYTDEERVDLWARRNELINKVIEIEYREEQTSSSTGKKSLRFPRFVRFRPDKE

SEQ ID NO: 1155 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcagattgtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1156 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQIVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1157 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccacgcagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1158 - protein, 437 aa, synthetic construct
  REGION 1..437: note = Engineered DNA ligase variant
MHHHHHHGGSGMTTQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1159 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaacccgctatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgagccatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1160 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTRYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVSHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1161 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccgaccgattatggtaacctgcaggataattacatttcctatcttgatctgacgagtaaattgtacaaccgtgaactgaccggtaatgcggcgctggattctttagcagtctttctgtcagactgcggcgtcaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgaccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaatcgggagaatcgacccagattctggagcaacgtattaatttcttacgcgaagtagacgaacagtacattcaagagctgccgctttcgaacctgagttgggtccagcctgatggcgtgttcgaagatagcgaggagagtcagcaggaagtgctgcgcctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1162 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGVKEAEWYMKSIQKDFKIGITAKSINKVIPCLIAEYSCALAKPLKKYPKRYSADRKLDGYRCNGFNYGGGKVVLKSRNGKIITGYTGIEQDIDQLPVGFMYDGEIMAPSGKFADVQKSAFKKSDDKQGILHIFDAVPIHEFESGESTQILEQRINFLREVDEQYIQELPLSNLSWVQPDGVFEDSEESQQEVLRLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1163 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgtggccaaccgattatggtaacctgcaggataattacatttcctatcttgatctgacgagtaaattgtacaaccgtgaactgaccggtaatgcggcgctgtcgtctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1164 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSWPTDYGNLQDNYISYLDLTSKLYNRELTGNAALSSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1165 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaagcagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccgaccctgtatggtaacctgcaggataattacatttcctatcttgatctgacgagtaaattgtacaatcgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgaccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccagattctggagcaacgtattaatttcttacgcgaagtagacgaacagtacattcaagagctgccgctttcgaacctggaatgggtccagcctgatggcgtgttcgaagatagcgaggagagtcagcaggaagtgtttcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1166 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIDQLPVGFMYDGEIMAPSGKFADVQKSAFKKSDDKQGILHIFDAVPIHEFEAGESTQILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1167 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1168 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFESGKEGTKNEGVLGALVVEYKGNEVSIGGGYTDEMRVDLWARRNELINKVIEIEYREEQTSSSTGKKSLRFPRFVRFRPDKE

SEQ ID NO: 1169 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgagccatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1170 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVSHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1171 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacactggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgaccctgattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1172 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTLILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1173 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccgaccctgtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagagggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1174 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1175 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccagccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccaaaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatggtgaggagagtcagcaggaagtgagccatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagatctcatcgagcaccggtaagaaatctttacgtttcccgcgttttgttcgctttcgtccggacaaagag

SEQ ID NO: 1176 - protein, 437 aa, synthetic construct
  REGION 1..437: note = Engineered DNA ligase variant
MHHHHHHGGSGMTSQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDGEESQQEVSHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQISSSTGKKSLRFPRFVRFRPDKE

SEQ ID NO: 1177 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagattataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggagtgggtccagcctgatggcgtgttcgaagatagcgaggagagtcagcaggaagtgtttcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagagggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1178 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDYKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1179 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaaacagattgttcaagcgtttgaactgctggaggcaatcggcggcactactagccgtatggccaaggaagatttcttgcgcgctggtgaagacaacgggatcttcaaagagattctcattcgcacctataatccggatctgatttaccgtgtgaaaaagaagatcaagatcaaatcgctgccaaccgactatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacactggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggagtgggtccagcctgatggcgtgttcgaagatagcgaggagagtcagcaggaagtgtttcacctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaatcgggtaaggaaggtaccaagaatgaaggcgttctgggtgcactggtcgtcgagtataaaggcaacgaagtttctattggcggcggatatacggacgaggagcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1180 - protein, 437 aa, synthetic construct
  REGION 1..437: note = Engineered DNA ligase variant
MHHHHHHGGSGMTKQIVQAFELLEAIGGTTSRMAKEDFLRAGEDNGIFKEILIRTYNPDLIYRVKKKIKIKSLPTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFESGKEGTKNEGVLGALVVEYKGNEVSIGGGYTDEERVDLWARRNELINKVIEIEYREEQTSSSTGKKSLRFPRFVRFRPDKE

SEQ ID NO: 1181 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccggccagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgccgaccctgtatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacactggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttaagcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1182 - protein, 437 aa, synthetic construct
  REGION 1..437: note = Engineered DNA ligase variant
MHHHHHHGGSGMTGQIVQAFELLEAIGGTTSRTAKEDFLRAGEDNGIFKEILIRTYNPDLIYRVKKKIKIKSLPTLYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLSEVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1183 - DNA, 1311 bp, synthetic construct
  misc_feature 1..1311: note = Engineered DNA ligase variant
  source 1..1311: mol_type = other DNA
atgcaccatcatcatcatcatggcggtagcggcatgaccaagcagattgttcaagcgtttgaactgctggaggcaatcggcggcactactagccgtacggccaaggaagatttcttgcgcgctggtgaagacaacgggatcttcaaagagattctcattcgcacctataatccggatctgatctaccgtgtgaaaaagaagatcaagatcaaatcgctgtcgaccgattatggtaacctgcaggataattacatttcctatcttgatctgacgagtaaattgtacaaccgtgaactgaccggtaatgcggcgctggattctttagcagtctttctgtcagactgcggccagaaagaagccgagtggtatatgaaaagcattcagaaagactttaagattgggatcacagccaaatcgattaacaaagtaattccgtgtcttatcgcggaatattcttgcgcactcgctaaacctctgaagaaatatccgaaacgctattccgccgatcgtaaactggatggataccgctgtaatggcttcaactatggtggtggaaaagtggtgttgaagagtcgcaatggtaagattattacgggttacaccggcatcgaacaagatatcgcccagttgcccgtgggctttatgtatgacggtgaaattatggcgccgtccggcaaatttgcagacgttcagaaaagtgccttcaagaaatcagatgataaacaggggattctgcatatctttgatgctgttccaatccacgagtttgaagcgggagaatcgacccgcattctggagcaacgtattaatttcttacgcgaagtagacgaacagtacattcaagagctgccgctttcgaacctggaatgggtccagcctgatggcgtgttcgaagatagcgaggagagtcagcaggaagtgtttcatctccaccgtcataatcgtgcccagggttatgaagggacgatgattaaagatttagacgcgacctacaaatgcaaacgctccttcgacatccaaaagatcgttgatgtaaaccgtgtcgacctgactgtggtgggctttgaagaaggtaaggaaggtaccaagaatgaaggcgttctgggtgcactggtcgtcgagtataaaggcaacgaagtttctattggcggcggatatacggacgagatgcgtgtggatctttgggctcgccgcaatgaactgatcaacaaagtgattgagattgaataccgtgaagaacagacatcatcgagcaccggtaagaaatctttacgtttcccgcgttttgttcgctttcgtccggacaaagag

SEQ ID NO: 1184 - protein, 437 aa, synthetic construct
  REGION 1..437: note = Engineered DNA ligase variant
MHHHHHHGGSGMTKQIVQAFELLEAIGGTTSRTAKEDFLRAGEDNGIFKEILIRTYNPDLIYRVKKKIKIKSLSTDYGNLQDNYISYLDLTSKLYNRELTGNAALDSLAVFLSDCGQKEAEWYMKSIQKDFKIGITAKSINKVIPCLIAEYSCALAKPLKKYPKRYSADRKLDGYRCNGFNYGGGKVVLKSRNGKIITGYTGIEQDIAQLPVGFMYDGEIMAPSGKFADVQKSAFKKSDDKQGILHIFDAVPIHEFEAGESTRILEQRINFLREVDEQYIQELPLSNLEWVQPDGVFEDSEESQQEVFHLHRHNRAQGYEGTMIKDLDATYKCKRSFDIQKIVDVNRVDLTVVGFEEGKEGTKNEGVLGALVVEYKGNEVSIGGGYTDEMRVDLWARRNELINKVIEIEYREEQTSSSTGKKSLRFPRFVRFRPDKE

SEQ ID NO: 1185 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcata

SEQ ID NO: 1186 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  source 1..50: mol_type = other DNA
ntgcatgatattaaatagcttggcagcaacaggactaggatgagtagcta

SEQ ID NO: 1187 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgctta

SEQ ID NO: 1188 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  source 1..50: mol_type = other DNA
nagcatgatattaaatagcttggcagcaacaggactaggatgagtagcta

SEQ ID NO: 1189 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcgta

SEQ ID NO: 1190 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  source 1..50: mol_type = other DNA
ncgcatgatattaaatagcttggcagcaacaggactaggatgagtagcta

SEQ ID NO: 1191 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgccta

SEQ ID NO: 1192 - DNA, 50 bp, synthetic construct
  misc_feature 1..50: note = Modified oligo substrate or product
  modified_base 1: mod_base = OTHER; note = MODIFIED_BASE - n is a 5-phosphorylated adenosine
  source 1..50: mol_type = other DNA
nggcatgatattaaatagcttggcagcaacaggactaggatgagtagcta

SEQ ID NO: 1193 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcaaa

SEQ ID NO: 1194 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  source 1..50: mol_type = other DNA
ntgcatgatattaaatagcttggcagcaacaggactaggatgagtagcaa

SEQ ID NO: 1195 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgctaa

SEQ ID NO: 1196 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  source 1..50: mol_type = other DNA
nagcatgatattaaatagcttggcagcaacaggactaggatgagtagcaa

SEQ ID NO: 1197 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcgaa

SEQ ID NO: 1198 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  source 1..50: mol_type = other DNA
ncgcatgatattaaatagcttggcagcaacaggactaggatgagtagcaa

SEQ ID NO: 1199 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgccaa

SEQ ID NO: 1200 - DNA, 50 bp, synthetic construct
  misc_feature 1..50: note = Modified oligo substrate or product
  modified_base 1: mod_base = OTHER; note = MODIFIED_BASE - n is a 5-phosphorylated thymidine
  source 1..50: mol_type = other DNA
nggcatgatattaaatagcttggcagcaacaggactaggatgagtagcaa

SEQ ID NO: 1201 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcaca

SEQ ID NO: 1202 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  source 1..50: mol_type = other DNA
ntgcatgatattaaatagcttggcagcaacaggactaggatgagtagcca

SEQ ID NO: 1203 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgctca

SEQ ID NO: 1204 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  source 1..50: mol_type = other DNA
nagcatgatattaaatagcttggcagcaacaggactaggatgagtagcca

SEQ ID NO: 1205 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcgca

SEQ ID NO: 1206 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  source 1..50: mol_type = other DNA
ncgcatgatattaaatagcttggcagcaacaggactaggatgagtagcca

SEQ ID NO: 1207 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgccca

SEQ ID NO: 1208 - DNA, 50 bp, synthetic construct
  misc_feature 1..50: note = Modified oligo substrate or product
  modified_base 1: mod_base = OTHER; note = MODIFIED_BASE - n is a 5-phosphorylated guanosine
  source 1..50: mol_type = other DNA
nggcatgatattaaatagcttggcagcaacaggactaggatgagtagcca

SEQ ID NO: 1209 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcaga

SEQ ID NO: 1210 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  source 1..50: mol_type = other DNA
ntgcatgatattaaatagcttggcagcaacaggactaggatgagtagcga

SEQ ID NO: 1211 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgctga

SEQ ID NO: 1212 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  source 1..50: mol_type = other DNA
nagcatgatattaaatagcttggcagcaacaggactaggatgagtagcga

SEQ ID NO: 1213 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgcgga

SEQ ID NO: 1214 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  source 1..50: mol_type = other DNA
ncgcatgatattaaatagcttggcagcaacaggactaggatgagtagcga

SEQ ID NO: 1215 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  modified_base 25: mod_base = OTHER; note = MODIFIED_BASE - n is a thymidine with 6-carboxyfluorescein attached to position 5 of the thymine ring by a 6-carbon spacer arm.
  source 1..50: mol_type = other DNA
ngctactcatcctagtcctgttgcngccaagctatttaatatcatgccga

SEQ ID NO: 1216 - DNA, 50 bp, synthetic construct
  misc_feature 1..50: note = Modified oligo substrate or product
  modified_base 1: mod_base = OTHER; note = MODIFIED_BASE - n is a 5-phosphorylated cytidine
  source 1..50: mol_type = other DNA
nggcatgatattaaatagcttggcagcaacaggactaggatgagtagcga

SEQ ID NO: 1217 - DNA, 20 bp, synthetic construct
  misc_feature 1..20: note = Modified oligo substrate or product
  modified_base 19^20: mod_base = OTHER; note = MODIFIED_BASE - There is a phosphorothioate bond between these base pairs.
  source 1..20: mol_type = other DNA
acacgacgctcttccgatct

SEQ ID NO: 1218 - DNA, 19 bp, synthetic construct
  misc_feature 1..19: note = Modified oligo substrate or product
  modified_base 1: mod_base = OTHER; note = MODIFIED_BASE - n is a 5-phosphorylated guanosine
  modified_base 19: mod_base = OTHER; note = MODIFIED_BASE - n is a 3'-amino modified thymidine
  source 1..19: mol_type = other DNA
natcggaagagcgtcgtgn

SEQ ID NO: 1219 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctagctactcatcctagtcctgttgcngccaagctatttaatatcatgcatagatcggaagagcgtcgtgn

SEQ ID NO: 1220 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctatgcatgatattaaatagcttggcagcaacaggactaggatgagtagctagatcggaagagcgtcgtgn

SEQ ID NO: 1221 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctagctactcatcctagtcctgttgcngccaagctatttaatatcatgcttagatcggaagagcgtcgtgn

SEQ ID NO: 1222 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctaagcatgatattaaatagcttggcagcaacaggactaggatgagtagctagatcggaagagcgtcgtgn

SEQ ID NO: 1223 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctagctactcatcctagtcctgttgcngccaagctatttaatatcatgcgtagatcggaagagcgtcgtgn

SEQ ID NO: 1224 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctacgcatgatattaaatagcttggcagcaacaggactaggatgagtagctagatcggaagagcgtcgtgn

SEQ ID NO: 1225 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctagctactcatcctagtcctgttgcngccaagctatttaatatcatgcctagatcggaagagcgtcgtgn

SEQ ID NO: 1226 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctaggcatgatattaaatagcttggcagcaacaggactaggatgagtagctagatcggaagagcgtcgtgn

SEQ ID NO: 1227 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatcttgctactcatcctagtcctgttgcngccaagctatttaatatcatgcaaagatcggaagagcgtcgtgn

SEQ ID NO: 1228 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctttgcatgatattaaatagcttggcagcaacaggactaggatgagtagcaagatcggaagagcgtcgtgn

SEQ ID NO: 1229 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatcttgctactcatcctagtcctgttgcngccaagctatttaatatcatgctaagatcggaagagcgtcgtgn

SEQ ID NO: 1230 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatcttagcatgatattaaatagcttggcagcaacaggactaggatgagtagcaagatcggaagagcgtcgtgn

SEQ ID NO: 1231 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatcttgctactcatcctagtcctgttgcngccaagctatttaatatcatgcgaagatcggaagagcgtcgtgn

SEQ ID NO: 1232 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatcttcgcatgatattaaatagcttggcagcaacaggactaggatgagtagcaagatcggaagagcgtcgtgn

SEQ ID NO: 1233 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatcttgctactcatcctagtcctgttgcngccaagctatttaatatcatgccaagatcggaagagcgtcgtgn

SEQ ID NO: 1234 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatcttggcatgatattaaatagcttggcagcaacaggactaggatgagtagcaagatcggaagagcgtcgtgn

SEQ ID NO: 1235 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctggctactcatcctagtcctgttgcngccaagctatttaatatcatgcacagatcggaagagcgtcgtgn

SEQ ID NO: 1236 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctgtgcatgatattaaatagcttggcagcaacaggactaggatgagtagccagatcggaagagcgtcgtgn

SEQ ID NO: 1237 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctggctactcatcctagtcctgttgcngccaagctatttaatatcatgctcagatcggaagagcgtcgtgn

SEQ ID NO: 1238 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctgagcatgatattaaatagcttggcagcaacaggactaggatgagtagccagatcggaagagcgtcgtgn

SEQ ID NO: 1239 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctggctactcatcctagtcctgttgcngccaagctatttaatatcatgcgcagatcggaagagcgtcgtgn

SEQ ID NO: 1240 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctgcgcatgatattaaatagcttggcagcaacaggactaggatgagtagccagatcggaagagcgtcgtgn

SEQ ID NO: 1241 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctggctactcatcctagtcctgttgcngccaagctatttaatatcatgcccagatcggaagagcgtcgtgn

SEQ ID NO: 1242 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctgggcatgatattaaatagcttggcagcaacaggactaggatgagtagccagatcggaagagcgtcgtgn

SEQ ID NO: 1243 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctcgctactcatcctagtcctgttgcngccaagctatttaatatcatgcagagatcggaagagcgtcgtgn

SEQ ID NO: 1244 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctctgcatgatattaaatagcttggcagcaacaggactaggatgagtagcgagatcggaagagcgtcgtgn

SEQ ID NO: 1245 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctcgctactcatcctagtcctgttgcngccaagctatttaatatcatgctgagatcggaagagcgtcgtgn

SEQ ID NO: 1246 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctcagcatgatattaaatagcttggcagcaacaggactaggatgagtagcgagatcggaagagcgtcgtgn

SEQ ID NO: 1247 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctcgctactcatcctagtcctgttgcngccaagctatttaatatcatgcggagatcggaagagcgtcgtgn

SEQ ID NO: 1248 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctccgcatgatattaaatagcttggcagcaacaggactaggatgagtagcgagatcggaagagcgtcgtgn

SEQ ID NO: 1249 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  modified_base 89: mod_base = OTHER; note = MODIFIED_BASE - n is a 3'-amino modified thymidine
  source 1..89: mol_type = other DNA
acacgacgctcttccgatctcgctactcatcctagtcctgttgcngccaagctatttaatatcatgccgagatcggaagagcgtcgtgn

SEQ ID NO: 1250 - DNA, 89 bp, synthetic construct
  misc_feature 1..89: note = Modified oligo substrate or product
  modified_base 19^20: mod_base = OTHER; note = MODIFIED_BASE - There is a phosphorothioate bond between these base pairs.
  modified_base 89: mod_base = OTHER; note = MODIFIED_BASE - n is a 3'-amino modified thymidine
  source 1..89: mol_type = other DNA
acacgacgctcttccgatctcggcatgatattaaatagcttggcagcaacaggactaggatgagtagcgagatcggaagagcgtcgtgn

SEQ ID NO: 1251 - DNA, 70 bp, synthetic construct
  misc_feature 1..70: note = Modified oligo substrate or product
  modified_base 19^20: mod_base = OTHER; note = MODIFIED_BASE - There is a phosphorothioate bond between these base pairs.
  modified_base 45: mod_base = OTHER; note = MODIFIED_BASE - n is a thymidine with 6-carboxyfluorescein attached to position 5 of the thymine ring by a 6-carbon spacer arm.
  source 1..70: mol_type = other DNA
acacgacgctcttccgatcttgctactcatcctagtcctgttgcngccaagctatttaatatcatgcaaa

SEQ ID NO: 1252 - DNA, 69 bp, synthetic construct
  misc_feature 1..69: note = Modified oligo substrate or product
  modified_base 69: mod_base = OTHER; note = MODIFIED_BASE - n is a 3'-amino modified thymidine
  source 1..69: mol_type = other DNA
ttgcatgatattaaatagcttggcagcaacaggactaggatgagtagcaagatcggaagagcgtcgtgn

SEQ ID NO: 1253 - DNA, 69 bp, synthetic construct
  misc_feature 1..69: note = Modified oligo substrate or product
  modified_base 25: mod_base = OTHER; note = MODIFIED_BASE - n is a thymidine with 6-carboxyfluorescein attached to position 5 of the thymine ring by a 6-carbon spacer arm.
  modified_base 69: mod_base = OTHER; note = MODIFIED_BASE - n is a 3'-amino modified thymidine
  source 1..69: mol_type = other DNA
tgctactcatcctagtcctgttgcngccaagctatttaatatcatgcaaagatcggaagagcgtcgtgn

SEQ ID NO: 1254 - DNA, 70 bp, synthetic construct
  misc_feature 1..70: note = Modified oligo substrate or product
  modified_base 19^20: mod_base = OTHER; note = MODIFIED_BASE - There is a phosphorothioate bond between these base pairs.
  source 1..70: mol_type = other DNA
acacgacgctcttccgatctttgcatgatattaaatagcttggcagcaacaggactaggatgagtagcaa

What is claimed is:

1. An engineered DNA ligase, or functional fragment thereof, wherein the DNA ligase or functional fragment thereof has DNA ligase activity and comprises an amino acid sequence sharing at least 85% but less than 100% sequence identity with:

(a) residues 12 to 437 of SEQ ID NO:2, wherein the amino acid sequence of the engineered DNA ligase comprises one or more substitutions relative to residues 12 to 437 of SEQ ID NO:2, or (b) the amino acid sequence of SEQ ID NO:2, wherein the amino acid sequence of the engineered DNA ligase comprises one or more substitutions relative to the amino acid sequence of SEQ ID NO:2, wherein the one or more substitutions occur at amino acid position 63, 242, 283, 286, 308, 317, 414, 415, 418, 428, or combinations thereof, wherein the amino acid positions are relative to the amino acid sequence of SEQ ID NO:2.

2. The engineered DNA ligase of claim 1, wherein the one or more substitutions are selected from the group consisting of 63F/R, 242P/Q/T, 283A/G/K/L/M/R/S/V, 286F/L/S, 308K/L/S, 317Q, 414A/L/Q/R/T/V, 415A/C/E/H/I/K/L/V, 418A/G/I/L/M/P/S/T, 428F/R/S, and combinations thereof, wherein the substitutions are relative to the amino acid sequence of SEQ ID NO:2.

3. The engineered DNA ligase of claim 2, wherein the one or more substitutions comprise 63R, 242Q, 283L, 286S, 308S, 317Q, 414Q, 415I, 418S, 428R, or combinations thereof, wherein the amino acid positions are relative to the amino acid sequence of SEQ ID NO:2.

4. The engineered DNA ligase of claim 1, 2 or 3, wherein the engineered DNA ligase is purified.

5. A recombinant polynucleotide comprising a polynucleotide sequence encoding the engineered DNA ligase of claim 1.

6. The recombinant polynucleotide of claim 5, comprising a polynucleotide sequence sharing at least 70% sequence identity with nucleotide residues 34 to 1311 of SEQ ID NO: 1, or with the nucleotide sequence of SEQ ID NO: 1.

7. An expression vector comprising the recombinant polynucleotide of claim 5.

8. A host cell comprising the expression vector of claim 7.

9. A method of producing an engineered DNA ligase polypeptide in a host cell, comprising culturing the host cell of claim 8 under culture conditions suitable for expression, thereby producing the engineered DNA ligase polypeptide.

10. The method of claim 9, further comprising recovering the engineered DNA ligase polypeptide from the culture and/or host cell.

11. The method of claim 10, further comprising purifying the engineered DNA ligase.

12. A composition comprising the engineered DNA ligase of claim 1.

13. A kit comprising the engineered DNA ligase of claim 1.

* * * * *